US007696330B2

(12) United States Patent
Meulen et al.

(10) Patent No.: US 7,696,330 B2
(45) Date of Patent: Apr. 13, 2010

(54) BINDING MOLECULES AGAINST SARS-CORONAVIRUS AND USES THEREOF

(75) Inventors: Jan H. Ter Meulen, Amsterdam (NL); Cornelis A. De Kruif, De Bilt (NL); Edward N. Van Den Brink, Halfweg (NL); Jaap Goudsmit, Amsterdam (NL)

(73) Assignee: Crucell Holland B.V., Leiden (NL)

( * ) Notice: Subject to any disclaimer, the term of this patent is extended or adjusted under 35 U.S.C. 154(b) by 744 days.

(21) Appl. No.: 11/337,300

(22) Filed: Jan. 20, 2006

(65) Prior Publication Data

US 2006/0121580 A1    Jun. 8, 2006

Related U.S. Application Data

(63) Continuation of application No. PCT/EP2004/051568, filed on Jul. 21, 2004.

(30) Foreign Application Priority Data

| Jul. 22, 2003 | (WO) | PCT/EP03/50328 |
| Sep. 1, 2003 | (WO) | PCT/EP03/50391 |
| Oct. 16, 2003 | (WO) | PCT/EP03/50723 |
| Nov. 24, 2003 | (WO) | PCT/EP03/50883 |
| Dec. 4, 2003 | (WO) | PCT/EP03/50943 |
| Feb. 2, 2004 | (WO) | PCT/EP2004/050067 |
| Feb. 13, 2004 | (WO) | PCT/EP2004/050127 |
| Mar. 19, 2004 | (WO) | PCT/EP2004/050334 |
| Apr. 7, 2004 | (WO) | PCT/EP2004/050464 |
| Apr. 14, 2004 | (WO) | PCT/EP2004/050516 |
| Apr. 29, 2004 | (WO) | PCT/EP2004/050643 |

(51) Int. Cl.
*C07K 16/00* (2006.01)
*C12Q 1/00* (2006.01)
*G01N 33/563* (2006.01)

(52) U.S. Cl. ............. 530/388.8; 530/387.3; 530/388.1; 435/5; 435/7.1

(58) Field of Classification Search ................ None
See application file for complete search history.

(56) References Cited

U.S. PATENT DOCUMENTS

2005/0069869 A1 *  3/2005  Ambrosino et al. ............ 435/5

FOREIGN PATENT DOCUMENTS

| WO | WO 03/013599 A2 | 2/2003 |
| WO | WO 2004/111081 A3 | 12/2004 |
| WO | WO 2005/012337 A2 | 2/2005 |
| WO | WO 2005/012338 A1 | 2/2005 |
| WO | WO 2005/012360 A2 | 2/2005 |

OTHER PUBLICATIONS

He Y et al. "Antigenic and immunogenic characterization of recombinant baculovirus-expressed severe acute respiratory syndrome coronavirus spike protein: implication for vaccine design". J Virol. Jun. 2006;80(12):5757-67.*

Mitsuki YY et al "A single amino acid substitution in the S1 and S2 Spike protein domains determines the neutralization escape phenotype of SARS-CoV". Microbes Infect. Jul. 2008;10(8):908-15. Epub Jun. 19, 2008.*

Yoo D et al "A single amino acid change within antigenic domain II of the spike protein of bovine coronavirus confers resistance to virus neutralization". Clin Diagn Lab Immunol. 2001, 8(2)::297-302.*

Weiss SR et al. "Coronavirus pathogenesis and the emerging pathogen severe acute respiratory syndrome coronavirus" Microbiol Mol Biol Rev. 2005; 69(4):635-64.*

Keller et al. "Passive immunity in prevention and treatment of infectious diseases". Clin Microbiol Rev. Oct. 2000;13(4):602-14.*

Cabezas et al., A structure-based approach to a synthetic vaccine for HIV-1, Biochemistry, Nov. 28, 2000, pp. 14377-91, vol. 39, No. 47. Abstract.

Corapi et al., Localization of antigenic sites of the S glycoprotein of Feline Infectious Peritonitis Virus involved in neutralization and antibody-dependent enhancement, Journal of Virology, The American Society of Microbiology, May 1995, pp. 2858-62, vol. 69, No. 5.

Ksiazek et al., A Novel Coronavirus Associated with Severe Acute Respiratory Syndrome, The New England Journal of Medicine, May 15, 2003, pp. 1953-1966, vol. 348, No. 20.

Li et al., The Structural Characterization and Antigenicity of the S Protein of SARS-CoV, Geno., Prot. & Bioinfo, May 2003, pp. 108-117, vol. 1, No. 2.

Lin et al., Identification of an epitope of SARS-coronavirus nucleocapsid protein, Cell Research, 2003, pp. 141-145, vol. 13, No. 3.

Marra et al., The genome sequence of the SARS-associated coronavirus, Science, May 30, 2003, pp. 1399-1404, vol. 300, No. 5624.

Posthumus et al., Analysis and Simulation of a Neutralizing Epitope of Transmissible Gastroenteritis Virus, Journal of Virology, Jul. 1, 1990, pp. 3304-09, vol. 64, No. 7.

Rota et al., Characterization of a novel coronavirus associated with severe acute respiratory syndrome, Sciencexpress, May 2003, pp. 1-10, (visited Nov. 30, 2005), www.sciencexpress.org.

Thiel et al., Mechanisms and enzymes involved in SARS coronavirus genome expression, Journal of General Virology, 2003, pp. 2305-2315, vol. 84.

Vicenzi et al., Coronaviridae and SARS-associated Coronavirus Strain HSR1, Emerging Infectious Diseases, Mar. 2004, pp. 413-418, vol. 10, No. 3.

Database Entrez Nucleotides, online, NCBI, Apr. 21, 2003, Monroe et al., SARS coronavirus Urbani Strain, Database accession No. AY278741.

(Continued)

*Primary Examiner*—Bo Peng
(74) *Attorney, Agent, or Firm*—TraskBritt

(57) ABSTRACT

The present invention provides binding molecules that specifically bind to SARS-CoV, nucleic acid molecules encoding the binding molecules, compositions comprising the binding molecules and methods of identifying or producing the binding molecules. The binding molecules are capable of specifically binding to SARS-CoV and can be used in the diagnosis, prophylaxis and/or treatment of a condition resulting from SARS-CoV.

11 Claims, 27 Drawing Sheets

OTHER PUBLICATIONS

Database EMBL, Apr. 15, 2003, He et al., SARS coronavirus TOR2 complete genome, Database accession No. AY274119.
Database EMBL, Jun. 25, 2003, Vicenzi et al., SARS coronavirus HSR 1 complete genome, Database accession No. AY323977.
Database EMBL, online, Apr. 23, 2003, SARS coronavirus Urbani, complete genome, Database accession No. AY278741.
Database WPI, Section Ch, Week 200442, Class B04, AN 2004-441790, Apr. 14, 2004.
Database WPI, Section Ch, Week 200432, Class B04, AN 2004-341229, Feb. 4, 2004.
Database WPI, Section Ch, Week 200478, Class B04, AN 2004-083758, Nov. 25, 2004.
PCT International Search Report, PCT/EP2004\051568, dated Aug. 22, 2005.

* cited by examiner

5' Cloning site of pPicZαB

```
                  KEK2
                  Cleavage
                  site
     XhoI                           EcoRI         SfiI
     ------         ↓               ------        ---------------
      S   L   E   K  R  E   A   E   A   G   I   H   V   A   Q   P   A    (SEQ ID NO:482)
1151 TCTCTCGAGA AAAGAGAGGC TGAAGCTGCA GGAATTCACG TGGCCCAGCC GGCCG (SEQ ID NO:72)
     AGAGAGCTCT TTTCTCTCCG ACTTCGACGT CCTTAAGTGC ACCGGGTCGG CCGGC (SEQ ID NO:479)
```

5' Cloning site of pPicZFVH

```
                  KEK2
                  Cleavage
                  site
     XhoI                NcoI           EcoRI         SfiI
     ------         ↓    -----          ------        ---------------
      S   L   E   K  R  A   M   E   A   A   G   I   H   V   A   Q   P   A    (SEQ ID NO:483)
1151 TCTCTCGAGA AAAGAGCCATGGAAGCTGCA GGAATTCACG TGGCCCAGCC GGCCG (SEQ ID NO:73)
     AGAGAGCTCT TTTCTCGGTACCTTCGACGT CCTTAAGTGC ACCGGGTCGG CCGGC (SEQ ID NO:480)
``` synthetic hinge fragment

```
                                                         Cysteine residues
                                                         available for
                          Flexible upper                 disulphide bonding
         ←────             hinge region
         NotI              ─────────────                    ↙      ↘
         --------
          A   A   A   P   K   P   S   T   P   P   G   S   S   C   P   P   C .
     1  GCGGCCGCGC CAAAGCCAAG TACCCCACCA GGTTCTTCAT GTCCACCATG
        CGCCGGCGCG GTTTCGGTTC ATGGGGTGGT CCAAGAAGTA CAGGTGGTAC Short linker          ClaI         XbaI
         ─────────────         ------       -------
         .  P   G   S   G   G   A   P   I   D   S   G   F   L    (SEQ ID NO:484)
     51  TCCAGGCTCT GGCGGTGCGC CAATCGATAG CGGCTTTCTA GA    (SEQ ID NO:74)
         AGGTCCGAGA CCGCCACGCG GTTAGCTATC GCCGAAAGAT CT    (SEQ ID NO:481)
```

FIG. 3C

SARS-CoV excretion

FIG. 18

SARS-CoV lung titers *(TCID50/ml)*

FIG. 19

Lung-pathology score

BINDING MOLECULES AGAINST SARS-CORONAVIRUS AND USES THEREOF

CROSS-REFERENCE TO RELATED APPLICATIONS

This application is a continuation of PCT International Patent Application No. PCT/EP2004/051568, filed on Jul. 21, 2004, designating the United States of America, and published, in English, as PCT International Publication No. WO 2005/012360 A2 on Feb. 10, 2005, which application claims priority to International Patent Application No. PCT/EP04/050643 filed Apr. 29, 2004, which claims priority to International Patent Application No. PCT/EP04/050516 filed Apr. 14, 2004, which claims priority to International Patent Application No. PCT/EP04/050464 filed Apr. 7, 2004, which claims priority to International Patent Application No. PCT/EP04/050334 filed Mar. 19, 2004, which claims priority to International Patent Application No. PCT/EP04/050127 filed Feb. 13, 2004, which claims priority to International Patent Application No. PCT/EP04/050067 filed Feb. 2, 2004, which claims priority to International Patent Application No. PCT/EP03/50943 filed Dec. 4, 2003, which claims priority to International Patent Application No. PCT/EP03/50883 filed Nov. 24, 2003, which claims priority to International Patent Application No. PCT/EP03/50723 filed Oct. 16, 2003, which claims priority to International Patent Application No. PCT/EP03/50391 filed Sep. 1, 2003, which, in turn, claims priority to International Patent Application No. PCT/EP03/50328 filed Jul. 22, 2003, the contents of the entirety of each of which are incorporated by this reference.

STATEMENT ACCORDING TO 37 C.F.R. §1.52(e)(5)—SEQUENCE LISTING SUBMITTED ON COMPACT DISC

Pursuant to 37 C.F.R. §1.52(e)(1)(ii), a compact disc containing an electronic version of the Sequence Listing has been submitted concomitant with this application, the contents of which are hereby incorporated by reference. A second compact disc is submitted and is an identical copy of the first compact disc. The discs are labeled "copy 1" and "copy 2," respectively, and each disc contains one file entitled "2578-7586US seq listing.txt" which is 811 KB and created on Jan. 20, 2006.

FIELD OF THE INVENTION

In general, various embodiments of thew present invention relate to biotechnology. More particularly, embodiments of the invention relate to medicine. In particular, the invention relates to binding molecules capable of specifically binding to SARS-coronavirus (SARS-CoV). The binding molecules are useful in the diagnosis of SARS CoV and the prophylaxis and/or treatment of a condition resulting from SARS-CoV.

BACKGROUND OF THE INVENTION

Recently a new and in several cases deadly clinical syndrome was observed in the human population, now called severe acute respiratory syndrome (SARS) (Holmes, 2003). The syndrome is caused by a novel coronavirus (Ksiazek et al., 2003), referred to as the SARS-CoV. The genome sequence of SARS-CoV has been determined (Rota et al., 2003; Marra et al., 2003). However, much remains to be learnt about this virus, and means and methods for diagnostics, prophylaxis and/or treatment of the virus and the syndrome are needed. The present invention provides means and methods for use in diagnostics, prevention and/or treatment of SARS-CoV.

DESCRIPTION OF THE FIGURES

In FIG. 6A detection was performed with a polyclonal rabbit antiserum recognizing the complete SARS-CoV. In FIG. 6B detection was performed with a polyclonal rabbit antiserum (IMG-542) recognizing the spike protein of SARS-CoV. In FIG. 6C detection was performed with a polyclonal rabbit antiserum (IMG-543) recognizing the nucleocapsid (N) protein of SARS-CoV and in FIG. 6D detection was performed with another polyclonal rabbit antiserum (IMG-557) recognizing the spike protein of SARS-CoV.

FIG. 18 shows SARS-CoV secretion at days 2, 4 and 7 of ferrets inoculated with a virus-control antibody mixture or a virus-03-014 antibody mixture.

FIG. 19 shows SARS-CoV lung titers at days 4 and 7 of ferrets inoculated with a virus-control antibody mixture or a virus-03-014 antibody mixture. The dashed line represents the detection limit of the assay.

FIG. 20 shows the lung pathology score at days 4 and 7 of ferrets inoculated with a virus-control antibody mixture or a virus-03-014 antibody mixture.

FIG. 21 shows SARS-CoV titration in lung homogenates on day 4 after challenge. SARS-CoV lung titers of ferrets administered with control antibody (named control) or with antibody 03-014 (named CR3014) are shown.

FIG. 24 shows electron micrographs of ultra-thin sections of Vero cells infected with SARS-CoV.

DESCRIPTION OF THE INVENTION

Figure 1:
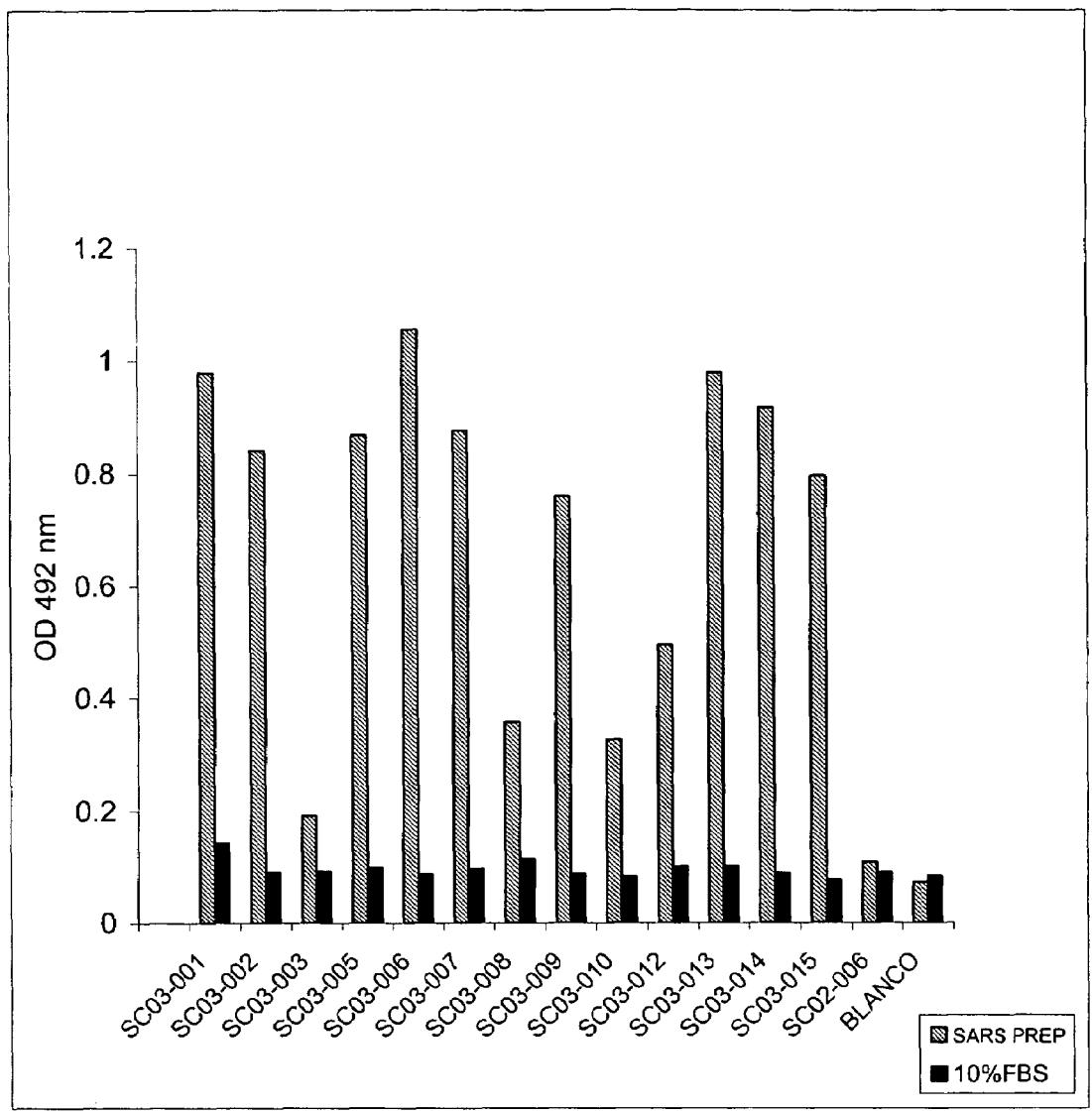
FIG. 1 shows results from an ELISA, wherein the binding of the single-chain phage antibodies called SC03-001, SC03-002, SC03-003, SC03-005, SC03-006, SC03-007, SC03-008, SC03-009, SC03-0010, SC03-012, SC03-013, SC03-014 and SC03-015 to an immobilized SARS-CoV preparation (left column) or immobilized FBS (right column) was measured. The binding of the control single-chain phage antibody called SC02-006 is also shown. On the y-axis the absorbance (OD) at 492 nm is shown.
Figure 2:
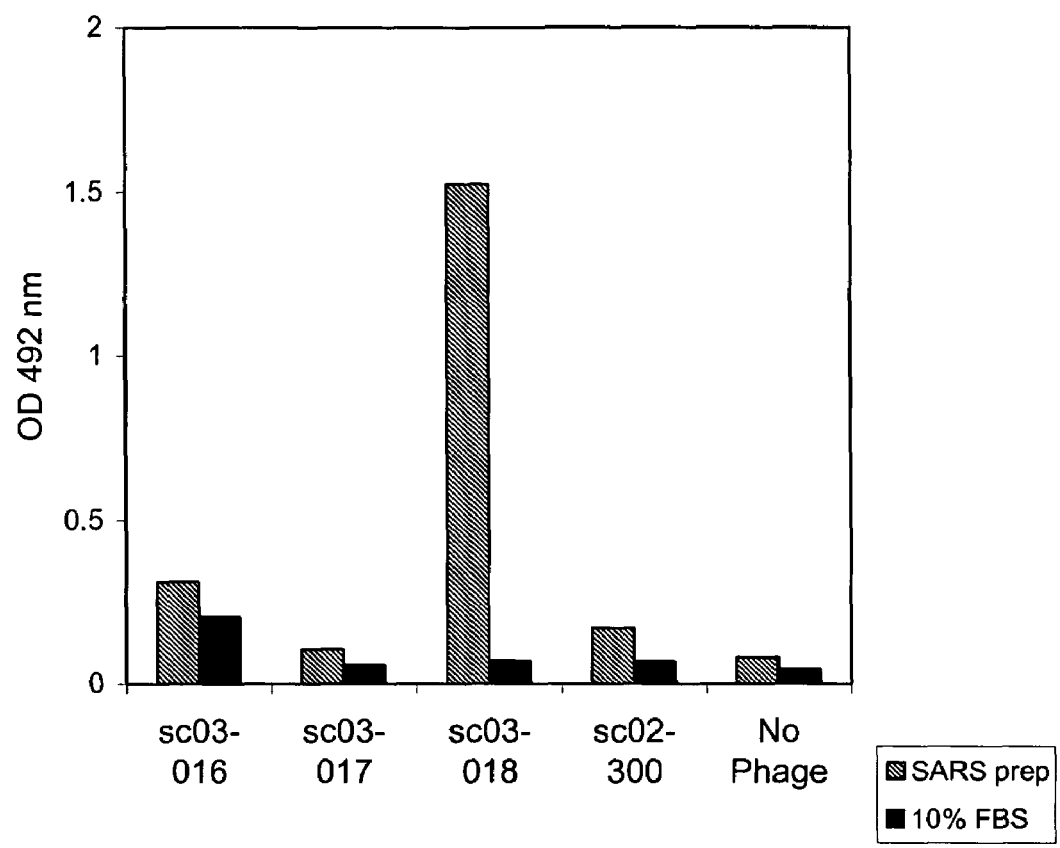
FIG. 2 shows results from an ELISA, wherein the binding of the single-chain phage antibodies called SC03-016, SC03-017 and SC03-018 to an immobilized SARS-CoV preparation (left column) or immobilized FBS (right column) was measured. The binding of the control single-chain phage antibody called SC02-300 is also shown. On the y-axis the absorbance (OD) at 492 nm is shown.

Herebelow follow definitions of terms as used in the invention

DEFINITIONS

Amino acid sequence. The term "amino acid sequence" as used herein refers to naturally occurring or synthetic molecules and to a peptide, oligopeptide, polypeptide or protein sequence.

Binding molecule. As used herein the term "binding molecule" refers to an intact immunoglobulin including monoclonal antibodies, such as chimeric, humanized or human monoclonal antibodies, or to an antigen-binding and/or variable domain comprising fragment of an immunoglobulin that competes with the intact immunoglobulin for specific binding to the binding partner of the immunoglobulin, e.g., the SARS-CoV. Regardless of structure, the antigen-binding fragment binds with the same antigen that is recognized by the intact immunoglobulin. An antigen-binding fragment can comprise a peptide or polypeptide comprising an amino acid sequence of at least two contiguous amino acid residues, at least five contiguous amino acid residues, at least ten contiguous amino acid residues, at least 15 contiguous amino acid residues, at least 20 contiguous amino acid residues, at least 25 contiguous amino acid residues, at least 30 contiguous amino acid residues, at least 35 contiguous amino acid residues, at least 40 contiguous amino acid residues, at least 50 contiguous amino acid residues, at least 60 contiguous amino residues, at least 70 contiguous amino acid residues, at least contiguous 80 amino acid residues, at least contiguous 90 amino acid residues, at least contiguous 100 amino acid residues, at least contiguous 125 amino acid residues, at least 150 contiguous amino acid residues, at least contiguous 175 amino acid residues, at least 200 contiguous amino acid residues, or at least contiguous 250 amino acid residues of the amino acid sequence of the binding molecule.

The term "binding molecule," as used herein includes all immunoglobulin classes and subclasses known in the art. Depending on the amino acid sequence of the constant domain of their heavy chains, binding molecules can be divided into the five major classes of intact antibodies: IgA, IgD, IgE, IgG, and IgM, and several of these may be further divided into subclasses (isotypes), e.g., IgA1, IgA2, IgG1, IgG2, IgG3 and IgG4.

Antigen-binding fragments include, inter alia, Fab, F(ab'), F(ab')$_2$, Fv, dAb, Fd, complementarity determining region (CDR) fragments, single-chain antibodies (scFv), bivalent single-chain antibodies, single-chain phage antibodies, diabodies, triabodies, tetrabodies, (poly)peptides that contain at least a fragment of an immunoglobulin that is sufficient to confer specific antigen binding to the (poly)peptide, etc. The above fragments may be produced synthetically or by enzymatic or chemical cleavage of intact immunoglobulins or they may be genetically engineered by recombinant DNA techniques. The methods of production are well known in the art and are described, for example, in Antibodies: A Laboratory Manual, Edited by: E. Harlow and D. Lane (1988), Cold Spring Harbor Laboratory, Cold Spring Harbor, N.Y., which is incorporated herein by reference. A binding molecule or antigen-binding fragment thereof may have one or more binding sites. If there is more than one binding site, the binding sites may be identical to one another or they may be different.

The binding molecule can be a naked or unconjugated binding molecule but can also be part of an immunoconjugate. A naked or unconjugated binding molecule is intended to refer to a binding molecule that is not conjugated, operatively linked or otherwise physically or functionally associated with an effector moiety or tag, such as inter alia a toxic substance, a radioactive substance, a liposome, an enzyme. It will be understood that naked or unconjugated binding molecules do not exclude binding molecules that have been stabilized, multimerized, humanized or in any other way manipulated, other than by the attachment of an effector moiety or tag. Accordingly, all post-translationally modified naked and unconjugated binding molecules are included herewith, including where the modifications are made in the natural binding molecule-producing cell environment, by a recombinant binding molecule-producing cell, and are introduced by the hand of man after initial binding molecule preparation. Of course, the term naked or unconjugated binding molecule does not exclude the ability of the binding molecule to form functional associations with effector cells and/or molecules after administration to the body, as some of such interactions are necessary in order to exert a biological effect. The lack of associated effector group or tag is, therefore, applied in definition to the naked or unconjugated binding molecule in vitro, not in vivo.

Biological sample. As used herein, the term "biological sample" encompasses a variety of sample types, including blood and other liquid samples of biological origin, solid tissue samples such as a biopsy specimen or tissue cultures, or cells derived therefrom and the progeny thereof. The term also includes samples that have been manipulated in any way after their procurement, such as by treatment with reagents, solubilization, or enrichment for certain components, such as proteins or polynucleotides. The term encompasses various kinds of clinical samples obtained from any species, and also includes cells in culture, cell supernatants and cell lysates.

Complementary determining regions (CDR). The term "complementary determining regions" as used herein means sequences within the variable regions of binding molecules, such as immunoglobulins, that usually contribute to a large extent to the antigen binding site which is complementary in shape and charge distribution to the epitope recognized on the antigen. The CDR regions can be specific for linear epitopes, discontinuous epitopes, or conformational epitopes of proteins or protein fragments, either as present on the protein in its native conformation or, in some cases, as present on the proteins as denatured, e.g., by solubilization in SDS. Epitopes may also consist of posttranslational modifications of proteins.

Deletion. The term "deletion," as used herein, denotes a change in either amino acid or nucleotide sequence in which one or more amino acid or nucleotide residues, respectively, are absent as compared to the parent, often the naturally occurring, molecule.

Expression-regulating nucleic acid sequence. The term "expression-regulating nucleic acid sequence" as used herein refers to polynucleotide sequences necessary for and/or affecting the expression of an operably linked coding sequence in a particular host organism. The expression-regulating nucleic acid sequences, such as inter alia appropriate transcription initiation, termination, promoter, enhancer sequences; repressor or activator sequences; efficient RNA processing signals such as splicing and polyadenylation signals; sequences that stabilize cytoplasmic mRNA; sequences that enhance translation efficiency (e.g., ribosome binding sites); sequences that enhance protein stability; and when desired, sequences that enhance protein secretion, can be any nucleic acid sequence showing activity in the host organism of choice and can be derived from genes encoding proteins, which are either homologous or heterologous to the host organism. The identification and employment of expression-regulating sequences is routine to the person skilled in the art.

Functional variant. The term "functional variant," as used herein, refers to a binding molecule that comprises a nucleotide and/or amino acid sequence that is altered by one or more nucleotides and/or amino acids compared to the nucleotide and/or amino acid sequences of the parent binding molecule and that is still capable of competing for binding to the binding partner, e.g., SARS-CoV, with the parent binding molecule. In other words, the modifications in the amino acid and/or nucleotide sequence of the parent binding molecule do not significantly affect or alter the binding characteristics of the binding molecule encoded by the nucleotide sequence or containing the amino acid sequence, i.e., the binding molecule is still able to recognize and bind its target. The functional variant may have conservative sequence modifications including nucleotide and amino acid substitutions, additions and deletions. These modifications can be introduced by standard techniques known in the art, such as site-directed mutagenesis and random PCR-mediated mutagenesis, and may comprise natural as well as non-natural nucleotides and amino acids.

Conservative amino acid substitutions include the ones in which the amino acid residue is replaced with an amino acid residue having similar structural or chemical properties. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine, tryptophan), nonpolar side chains (e.g., alanine, valine, leucine, isoleucine, proline, phenylalanine, methionine), beta-branched side chains (e.g., threonine, valine, isoleucine) and aromatic side chains (e.g., tyrosine, phenylalanine, tryptophan, histidine). It will be clear to the skilled artisan that other classifications of amino acid residue families than the one used above can also be employed. Furthermore, a variant may have non-conservative amino acid substitutions, e.g., replacement of an amino acid with an amino acid residue having different structural or chemical properties. Similar minor variations may also include amino acid deletions or insertions, or both. Guidance in determining which amino acid residues may be substituted, inserted, or deleted without abolishing immunological activity may be found using computer programs well known in the art.

A mutation in a nucleotide sequence can be a single alteration made at a locus (a point mutation), such as transition or transversion mutations, or alternatively, multiple nucleotides may be inserted, deleted or changed at a single locus. In addition, one or more alterations may be made at any number of loci within a nucleotide sequence. The mutations may be performed by any suitable method known in the art.

Host. The term "host," as used herein, is intended to refer to an organism or a cell into which a vector such as a cloning vector or an expression vector has been introduced. The organism or cell can be prokaryotic or eukaryotic. It should be understood that this term is intended to refer not only to the particular subject organism or cell, but to the progeny of such an organism or cell as well. Because certain modifications may occur in succeeding generations due to either mutation or environmental influences, such progeny may not, in fact, be identical to the parent organism or cell, but are still included within the scope of the term "host" as used herein.

Human. The term "human," when applied to binding molecules as defined herein, refers to molecules that are either directly derived from a human or based upon a human sequence. When a binding molecule is derived from or based on a human sequence and subsequently modified, it is still to be considered human as used throughout the specification. In other words, the term human, when applied to binding molecules is intended to include binding molecules having variable and constant regions derived from human germline immunoglobulin sequences based on variable or constant regions either or not occurring in a human or human lymphocyte or in modified form. Thus, the human binding molecules may include amino acid residues not encoded by human germline immunoglobulin sequences, comprise substitutions and/or deletions (e.g., mutations introduced by for instance random or site-specific mutagenesis in vitro or by somatic mutation in vivo). "Based on" as used herein refers to the situation that a nucleic acid sequence may be exactly copied from a template, or with minor mutations, such as by error-prone PCR methods, or synthetically made matching the template exactly or with minor modifications. Semisynthetic molecules based on human sequences are also considered to be human as used herein.

Insertion. The term "insertion," also known as the term "addition," denotes a change in an amino acid or nucleotide sequence resulting in the addition of one or more amino acid or nucleotide residues, respectively, as compared to the parent, often the naturally occurring, molecule.

Isolated. The term "isolated," when applied to binding molecules as defined herein, refers to binding molecules that are substantially free of other proteins or polypeptides, particularly free of other binding molecules having different antigenic specificities, and are also substantially free of other cellular material and/or chemicals. For example, when the binding molecules are recombinantly produced, they are preferably substantially free of culture medium, and when the binding molecules are produced by chemical synthesis, they are preferably substantially free of chemical precursors or other chemicals, i.e., they are separated from chemical precursors or other chemicals which are involved in the synthesis of the protein. The term "isolated" when applied to nucleic acid molecules encoding binding molecules as defined herein, is intended to refer to nucleic acid molecules in which the nucleotide sequences encoding the binding molecules are free of other nucleotide sequences, particularly nucleotide sequences encoding binding molecules that bind binding partners other than SARS-CoV. Furthermore, the term "isolated" refers to nucleic acid molecules that are substantially separated from other cellular components that naturally accompany the native nucleic acid molecule in its natural host, e.g., ribosomes, polymerases, or genomic sequences with which it is naturally associated. Moreover, "isolated" nucleic acid molecules, such as a cDNA molecules, can be substantially free of other cellular material, or culture medium when produced by recombinant techniques, or substantially free of chemical precursors or other chemicals when chemically synthesized.

Monoclonal antibody. The term "monoclonal antibody" as used herein refers to a preparation of antibody molecules of single molecular composition. A monoclonal antibody displays a single binding specificity and affinity for a particular epitope. Accordingly, the term "human monoclonal antibody" refers to an antibody displaying a single binding specificity which has variable and constant regions derived from or based on human germline immunoglobulin sequences or derived from completely synthetic sequences. The method of preparing the monoclonal antibody is not relevant.

Naturally occurring. The term "naturally occurring" as used herein as applied to an object refers to the fact that an object can be found in nature. For example, a polypeptide or polynucleotide sequence that is present in an organism that can be isolated from a source in nature and which has not been intentionally modified by man in the laboratory is naturally occurring.

Nucleic acid molecule. The term "nucleic acid molecule," as used in the present invention, refers to a polymeric form of nucleotides and includes both sense and antisense strands of RNA, cDNA, genomic DNA, and synthetic forms and mixed polymers of the above. A nucleotide refers to a ribonucleotide, deoxynucleotide or a modified form of either type of nucleotide. The term also includes single- and double-stranded forms of DNA. In addition, a polynucleotide may include either or both naturally occurring and modified nucleotides linked together by naturally occurring and/or non-naturally occurring nucleotide linkages. The nucleic acid molecules may be modified chemically or biochemically or may contain non-natural or derivatized nucleotide bases, as will be readily appreciated by those of skill in the art. Such modifications include, for example, labels, methylation, substitution of one or more of the naturally occurring nucleotides with an analog, internucleotide modifications such as uncharged linkages (e.g., methyl phosphonates, phosphotriesters, phosphoramidates, carbamates, etc.), charged linkages (e.g., phosphorothioates, phosphorodithioates, etc.), pendent moieties (e.g., polypeptides), intercalators (e.g., acridine, psoralen, etc.), chelators, alkylators, and modified linkages (e.g., alpha anomeric nucleic acids, etc.). The above term is also intended to include any topological conformation, including single-stranded, double-stranded, partially duplexed, triplex, hairpinned, circular and padlocked conformations. Also included are synthetic molecules that mimic polynucleotides in their ability to bind to a designated sequence via hydrogen bonding and other chemical interactions. Such molecules are known in the art and include, for example, those in which peptide linkages substitute for phosphate linkages in the backbone of the molecule. A reference to a nucleic acid sequence encompasses its complement unless otherwise specified. Thus, a reference to a nucleic acid molecule having a particular sequence should be understood to encompass its complementary strand, with its complementary sequence. The complementary strand is also useful, e.g., for antisense therapy, hybridization probes and PCR primers.

Operably linked. The term "operably linked" refers to two or more nucleic acid sequence elements that are usually physically linked and are in a functional relationship with each other. For instance, a promoter is operably linked to a coding sequence if the promoter is able to initiate or regulate the transcription or expression of a coding sequence, in which case the coding sequence should be understood as being "under the control of" the promoter.

Pharmaceutically acceptable excipient. By "pharmaceutically acceptable excipient" is meant any inert substance that is combined with an active molecule such as a drug, agent, or binding molecule for preparing an agreeable or convenient dosage form. The "pharmaceutically acceptable excipient" is an excipient that is non-toxic to recipients at the dosages and concentrations employed and is compatible with other ingredients of the formulation comprising the drug, agent or binding molecule.

Specifically Binding. The term "specifically binding," as used herein, in reference to the interaction of a binding molecule, e.g., an antibody, and its binding partner, e.g., an antigen, means that the interaction is dependent upon the presence of a particular structure, e.g., an antigenic determinant or epitope, on the binding partner. In other words, the antibody preferentially binds or recognizes the binding partner even when the binding partner is present in a mixture of other molecules or organisms. The binding may be mediated by covalent or non-covalent interactions or a combination of both. In yet other words, the term "specifically binding" means immunospecifically binding to an antigen or a fragment thereof and not immunospecifically binding to other antigens. A binding molecule that immunospecifically binds to an antigen may bind to other peptides or polypeptides with lower affinity as determined by, e.g., radioimmunoassays (RIA), enzyme-linked immunosorbent assays (ELISA), BIA-CORE, or other assays known in the art. Binding molecules or fragments thereof that immunospecifically bind to an antigen may be cross-reactive with related antigens. Preferably, binding molecules or fragments thereof that immunospecifically bind to an antigen do not cross-react with other antigens.

Substitutions. A "substitution," as used herein, denotes the replacement of one or more amino acids or nucleotides by different amino acids or nucleotides, respectively.

Therapeutically effective amount. The term "therapeutically effective amount" refers to an amount of the binding molecule as defined herein that is effective for preventing, ameliorating and/or treating a condition resulting from infection with SARS-CoV.

Treatment. The term "treatment" refers to therapeutic treatment as well as prophylactic or preventative measures to cure or halt or at least retard disease progress. Those in need of treatment include those already inflicted with a condition resulting from infection with SARS-CoV as well as those in which infection with SARS-CoV is to be prevented. Subjects partially or totally recovered form infection with SARS-CoV might also be in need of treatment. Prevention encompasses inhibiting or reducing the spread of SARS-CoV or inhibiting or reducing the onset, development or progression of one or more of the symptoms associated with infection with SARS-CoV.

Vector. The term "vector" denotes a nucleic acid molecule into which a second nucleic acid molecule can be inserted for introduction into a host where it will be replicated, and in some cases expressed. In other words, a vector is capable of transporting a nucleic acid molecule to which it has been linked. Cloning as well as expression vectors are contemplated by the term "vector," as used herein. Vectors include, but are not limited to, plasmids, cosmids, bacterial artificial chromosomes (BAC) and yeast artificial chromosomes (YAC) and vectors derived from bacteriophages or plant or animal (including human) viruses. Vectors comprise an origin of replication recognized by the proposed host and in case of expression vectors, promoter and other regulatory regions recognized by the host. A vector containing a second nucleic acid molecule is introduced into a cell by transformation, transfection, or by making use of viral entry mechanisms. Certain vectors are capable of autonomous replication in a host into which they are introduced (e.g., vectors having a bacterial origin of replication can replicate in bacteria). Other vectors can be integrated into the genome of a host upon introduction into the host, and thereby are replicated along with the host genome.

SUMMARY OF THE INVENTION

The invention provides binding molecules capable of specifically binding to SARS-CoV. In a preferred embodiment, the binding molecules are human binding molecules. Furthermore, the invention pertains to nucleic acid molecules encoding at least the binding region of the binding molecules. The invention further provides for the use of the binding molecules of the invention in the prophylaxis and/or treatment of a subject having, or at risk of developing, a condition resulting from SARS-CoV. Besides that, the invention pertains to the use of the binding molecules of the invention in the diagnosis/detection of SARS-CoV.

DETAILED DESCRIPTION OF THE INVENTION

In a first aspect, the present invention encompasses binding molecule capable of specifically binding to SARS-CoV. The binding molecules may be capable of specifically binding to SARS-CoV in activated or inactivated/attenuated form. Methods for inactivating/attenuating viruses are well known in the art and include, but are not limited to, heat inactivation, inactivation by UV irradiation, inactivation by gamma irradiation. The binding molecules may also be capable of specifically binding to one or more fragments of the SARS-CoV such as inter alia a preparation of one or more proteins and/or (poly)peptides derived from SARS-CoV. For methods of treatment and/or prevention of SARS the binding molecules are preferably capable of specifically binding to surface accessible proteins, which include, but are not limited to, inner and outer membrane proteins, proteins adhering to the cell wall, and potential secreted proteins. Surface accessible proteins of SARS-CoV include, but are not limited to, the spike protein, the membrane (matrix) protein, the (small) envelope protein, Orf 3, Orf 4, Orf 7, Orf 8, Orf 9, Orf 10 and Orf 14. For diagnostical purposes the binding molecules may also be capable of specifically binding to proteins not present on the surface of SARS-CoV. Therefore, proteins including, but not limited to, the nucleocapsid (N) protein, Orf 11 and Orf 13 may be used. The amino acid sequence of proteins and potential proteins of various known strains of SARS-CoV can be found in the EMBL-database and/or other databases. For instance the complete genome of the SARS coronavirus Urbani can be found in the EMBL-database under accession number AY278741, the complete genome of the SARS coronavirus HSR 1 can be found under accession number AY323977, the complete genome of the SARS coronavirus Frankfurt 1 can be found under accession number AY291315 and the complete genome of the SARS coronavirus TOR2 can be found under accession number AY274119. Preferably, the fragment at least comprises an antigenic determinant recognized by the binding molecules of the invention. An "antigenic determinant" as used herein is a moiety, such as a SARS-CoV (poly)peptide, protein, glycoprotein, analog or fragment thereof, that is capable of binding to a binding molecule of the invention with sufficiently high affinity to form a detectable antigen-binding molecule complex.

The binding molecules, according to the invention, are preferably human binding molecules, preferably human monoclonal antibodies. They can be intact immunoglobulin molecules such as polyclonal or monoclonal antibodies, in particular human monoclonal antibodies, or the binding molecules can be antigen-binding fragments including, but not limited to, Fab, F(ab'), F(ab')$_2$, Fv, dAb, Fd, complementarity determining region (CDR) fragments, single-chain antibodies (scFv), bivalent single-chain antibodies, single-chain phage antibodies, diabodies, triabodies, tetrabodies, and (poly)peptides that contain at least a fragment of an immunoglobulin that is sufficient to confer specific antigen binding to the SARS-CoV or fragment thereof. The binding molecules of the invention can be used in non-isolated or isolated form. Furthermore, the binding molecules of the invention can be used alone or in a mixture comprising at least one binding molecule (or variant or fragment thereof). In other words, the binding molecules can be used in combination, e.g., as a pharmaceutical composition comprising two or more binding molecules, variants or fragments thereof. For example, binding molecules having different, but complementary activities can be combined in a single therapy to achieve a desired prophylactic, therapeutic or diagnostic effect, but alternatively, binding molecules having identical activities can also be combined in a single therapy to achieve a desired prophylactic, therapeutic or diagnostic effect. The mixture may further comprise at least one other therapeutic agent. Preferably, the therapeutic agent is useful in the prophylaxis and/or treatment of a condition resulting from SARS-CoV.

Typically, binding molecules according to the invention can bind to their binding partners, i.e., SARS-CoV or fragments thereof, with an affinity constant ($K_d$-value) that is lower than $0.2*10^{-4}$ M, $1.0*10^{-5}$ M, $1.0*10^{-6}$ M, $1.0*10^{-7}$ M, preferably lower than $1.0*10^{-8}$ M, more preferably lower than $1.0*10^{-9}$ M, more preferably lower than $1.0*10^{-10}$ M, than $1.0*10^{-9}$ M, more preferably lower than $1.0*10^{-10}$ M, even more preferably lower than $1.0*10^{-11}$ M, and in particular lower than $1.0*10^{-12}$ M. The affinity constants can vary for antibody isotypes. For example, affinity binding for an IgM isotype refers to a binding affinity of at least about $1.0*10^{-7}$ M. Affinity constants can for instance be measured using surface plasmon resonance, i.e., an optical phenomenon that allows for the analysis of real-time biospecific interactions by detection of alterations in protein concentrations within a biosensor matrix, for example, using the BIA-CORE system (Pharmacia Biosensor AB, Uppsala, Sweden).

The binding molecules according to the invention may bind to SARS-CoV in soluble form such as for instance in a sample or may bind to SARS-CoV bound or attached to a carrier or substrate, e.g., microtiter plates, membranes and beads, etc. Carriers or substrates may be made of glass, plastic (e.g., polystyrene), polysaccharides, nylon, nitrocellulose, or teflon, etc. The surface of such supports may be solid or porous and of any convenient shape. Furthermore, the binding molecules may bind to SARS-CoV in purified/isolated or non-purified/non-isolated form.

In a preferred embodiment of the invention, the binding molecules of the invention neutralize SARS-CoV infectivity. This may be achieved by preventing the attachment of SARS-CoV to possible receptors on host cells or inhibition of the release of RNA into the cytoplasm of the cell or prevention of RNA transcription or translation. In a specific embodiment, the binding molecules of the invention prevent SARS-CoV from infecting host cells by at least 99%, at least 95%, at least 90%, at least 85%, at least 80%, at least 75%, at least 70%, at least 60%, at least 50%, at least 45%, at least 40%, at least 45%, at least 35%, at least 30%, at least 25%, at least 20%, or at least 10% relative to infection of host cells by SARS-CoV in the absence of the binding molecules. Neutralization can for instance be measured as described herein.

Binding molecules of the invention, which do not prevent SARS-CoV from binding its host cell receptor, but inhibit or down-regulate SARS-CoV replication, can also be administered to a mammal to treat, prevent or ameliorate one or more symptoms associated with a SARS-CoV infection. The ability of a binding molecule to inhibit or down-regulate SARS-CoV replication may be determined by techniques known in the art, for example, the inhibition or down-regulation of SARS-CoV replication can be determined by detecting the SARS-CoV titer in a biological sample of a mammal, preferably a human. A binding molecule of the present invention may inhibit or down-regulate SARS-CoV replication by at least 99%, at least 95%, at least 90%, at least 85%, at least 80%, at least 75%, at least 70%, at least 60%, at least 50%, at least 45%, at least 40%, at least 45%, at least 35%, at least 30%, at least 25%, at least 20%, or at least 10% relative to SARS-CoV replication in absence of the binding molecules. Furthermore, the binding molecules of the invention may be complement-fixing binding molecules capable of assisting in the lysis of enveloped SARS-CoV. The binding molecules of the invention might also act as opsonins and augment phagocytosis of SARS-CoV either by promoting its uptake via Fc or C3b receptors or by agglutinating SARS-CoV to make it more easily phagocytosed.

In a preferred embodiment, the binding molecules according to the invention comprise at least a CDR3 region, preferably a heavy chain CDR3 region, comprising the amino acid sequence selected from the group consisting of SEQ ID NO:1, SEQ ID NO:2, SEQ ID NO:3, SEQ ID NO:4, SEQ ID NO:5, SEQ ID NO:6, SEQ ID NO:7, SEQ ID NO:8, SEQ ID NO:9, SEQ ID NO:10, SEQ ID NO:11, SEQ ID NO:12, SEQ ID NO:13, SEQ ID NO:75, SEQ ID NO:76, SEQ ID NO:77, SEQ ID NO:78, SEQ ID NO:291, SEQ ID NO:292, SEQ ID NO:293, SEQ ID NO:294, SEQ ID NO:295, SEQ ID NO:296, SEQ ID NO:297, SEQ ID NO:298, SEQ ID NO:299, SEQ ID NO:300 and SEQ ID NO:301.

In yet another embodiment, the binding molecules according to the invention comprise a variable heavy chain comprising an amino acid sequence selected from the group consisting of SEQ ID NO:15, SEQ ID NO:17, SEQ ID NO:19, SEQ ID NO:21, SEQ ID NO:23, SEQ ID NO:25, SEQ ID NO:27, SEQ ID NO:29, SEQ ID NO:31, SEQ ID NO:33, SEQ ID NO:35, SEQ ID NO:37, SEQ ID NO:39, SEQ ID NO:80, SEQ ID NO:82, SEQ ID NO:84, SEQ ID NO:86, SEQ ID NO:303, SEQ ID NO:307, SEQ ID NO:311, SEQ ID NO:315, SEQ ID NO:319, SEQ ID NO:323, SEQ ID NO:327, SEQ ID NO:331, SEQ ID NO:335, SEQ ID NO:339, SEQ ID NO:343, SEQ ID NO:347, SEQ ID NO:351, SEQ ID NO:355, SEQ ID NO:359, SEQ ID NO:363, SEQ ID NO:367, SEQ ID NO:371, SEQ ID NO:375, SEQ ID NO:379, SEQ ID NO:383, SEQ ID NO:387, SEQ ID NO:391, SEQ ID NO:395, SEQ ID NO:399, SEQ ID NO:403, SEQ ID NO:407, SEQ ID NO:411, SEQ ID NO:415, SEQ ID NO:419, SEQ ID NO:423, SEQ ID NO:427, SEQ ID NO:431, SEQ ID NO:435, SEQ ID NO:439, SEQ ID NO:443, SEQ ID NO:447, SEQ ID NO:451, SEQ ID NO:455 and SEQ ID NO:459.

In a further embodiment, the binding molecules according to the invention comprise a variable heavy chain comprising the amino acid sequence of SEQ ID NO:15 and a variable light chain comprising the amino acid sequence of SEQ ID NO:41, a variable heavy chain comprising the amino acid sequence of SEQ ID NO:17 and a variable light chain comprising the amino acid sequence of SEQ ID NO:41, a variable heavy chain comprising the amino acid sequence of SEQ ID NO:19 and a variable light chain comprising the amino acid sequence of SEQ ID NO:41, a variable heavy chain comprising the amino acid sequence of SEQ ID NO:21 and a variable light chain comprising the amino acid sequence of SEQ ID NO:41, a variable heavy chain comprising the amino acid sequence of SEQ ID NO:23 and a variable light chain comprising the amino acid sequence of SEQ ID NO:43, a variable heavy chain comprising the amino acid sequence of SEQ ID NO:25 and a variable light chain comprising the amino acid sequence of SEQ ID NO:41, a variable heavy chain comprising the amino acid sequence of SEQ ID NO:27 and a variable light chain comprising the amino acid sequence of SEQ ID NO:41, a variable heavy chain comprising the amino acid sequence of SEQ ID NO:29 and a variable light chain comprising the amino acid sequence of SEQ ID NO:41, a variable heavy chain comprising the amino acid sequence of SEQ ID NO:31 and a variable light chain comprising the amino acid sequence of SEQ ID NO:41, a variable heavy chain comprising the amino acid sequence of SEQ ID NO:33 and a variable light chain comprising the amino acid sequence of SEQ ID NO:45, a variable heavy chain comprising the amino acid sequence of SEQ ID NO:35 and a variable light chain comprising the amino acid sequence of SEQ ID NO:41, a variable heavy chain comprising the amino acid sequence of SEQ ID NO:37 and a variable light chain comprising the amino acid sequence of SEQ ID NO:41, a variable heavy chain comprising the amino acid sequence of SEQ ID NO:39 and a variable light chain comprising the amino acid sequence of SEQ ID NO:45, a variable heavy chain comprising the amino acid sequence of SEQ ID NO:80 and a variable light chain comprising the amino acid sequence of SEQ ID NO:41, a variable heavy chain comprising the amino acid sequence of SEQ ID NO:82 and a variable light chain comprising the amino acid sequence of SEQ ID NO:41, a variable heavy chain comprising the amino acid sequence of SEQ ID NO:84 and a variable light chain comprising the amino acid sequence of SEQ ID NO:88, a variable heavy chain comprising the amino acid sequence of SEQ ID NO:86 and a variable light chain comprising the amino acid sequence of SEQ ID NO:41, a variable heavy chain comprising the amino acid sequence of SEQ ID NO:303 and a variable light chain comprising the amino acid sequence of SEQ ID NO:305, a variable heavy chain comprising the amino acid sequence of SEQ ID NO:307 and a variable light chain comprising the amino acid sequence of SEQ ID NO:309, a variable heavy chain comprising the amino acid sequence of SEQ ID NO:311 and a variable light chain comprising the amino acid sequence of SEQ ID NO:313, a variable heavy chain comprising the amino acid sequence of SEQ ID NO:315 and a variable light chain comprising the amino acid sequence of SEQ ID NO:317, a variable heavy chain comprising the amino acid sequence of SEQ ID NO:319 and a variable light chain comprising the amino acid sequence of SEQ ID NO:321, a variable heavy chain comprising the amino acid sequence of SEQ ID NO:323 and a variable light chain comprising the amino acid sequence of SEQ ID NO:325, a variable heavy chain comprising the amino acid sequence of SEQ ID NO:327 and a variable light chain comprising the amino acid sequence of SEQ ID NO:329, a variable heavy chain comprising the amino acid sequence of SEQ ID NO:331 and a variable light chain comprising the amino acid sequence of SEQ ID NO:333, a variable heavy chain comprising the amino acid sequence of SEQ ID NO:335 and a variable light chain comprising the amino acid sequence of SEQ ID NO:337, a variable heavy chain comprising the amino acid sequence of SEQ ID NO:339 and a variable light chain comprising the amino acid sequence of SEQ ID NO:341, a variable heavy chain comprising the amino acid sequence of SEQ ID NO:343 and a variable light chain comprising the amino acid sequence of SEQ ID NO:345, a variable heavy chain comprising the amino acid sequence of SEQ ID NO:347 and a variable light chain comprising the amino acid sequence of SEQ ID NO:349, a variable heavy chain comprising the amino acid sequence of SEQ ID NO:351 and a variable light chain comprising the amino acid sequence of SEQ ID NO:353, a variable heavy chain comprising the amino acid sequence of SEQ ID NO:355 and a variable light chain comprising the amino acid sequence of SEQ ID NO:357, a variable heavy chain comprising the amino acid sequence of SEQ ID NO:359 and a variable light chain comprising the amino acid sequence of SEQ ID NO:361, a variable heavy chain comprising the amino acid sequence of SEQ ID NO:363 and a variable light chain comprising the amino acid sequence of SEQ ID NO:365, a variable heavy chain comprising the amino acid sequence of SEQ ID NO:367 and a variable light chain comprising the amino acid sequence of SEQ ID NO:369, a variable heavy chain comprising the amino acid sequence of SEQ ID NO:371 and a variable light chain comprising the amino acid sequence of SEQ ID NO:373, a variable heavy chain comprising the amino acid sequence of SEQ ID NO:375 and a variable light chain comprising the amino acid sequence of SEQ ID NO:377, a variable heavy chain comprising the amino acid sequence of SEQ ID NO:379 and a variable light chain comprising the amino acid sequence of SEQ ID NO:381, a variable heavy chain comprising the amino acid sequence of SEQ ID NO:383 and a variable light chain comprising the amino acid sequence of SEQ ID NO:385, a variable heavy chain comprising the amino acid sequence of SEQ ID NO:387 and a variable light chain comprising the amino acid sequence of SEQ ID NO:389, a variable heavy chain comprising the amino acid sequence of SEQ ID NO:391 and a variable light chain comprising the amino acid sequence of SEQ ID NO:393, a variable heavy chain comprising the amino acid sequence of SEQ ID NO:395 and a variable light chain comprising the amino acid sequence of SEQ ID NO:397, a variable heavy chain comprising the amino acid sequence of SEQ ID NO:399 and a variable light chain comprising the amino acid sequence of SEQ ID NO:401, a variable heavy chain comprising the amino acid sequence of SEQ ID NO:403 and a variable light chain comprising the amino acid sequence of SEQ ID NO:405, a variable heavy chain comprising the amino acid sequence of SEQ ID NO:407 and a variable light chain comprising the amino acid sequence of SEQ ID NO:409, a variable heavy chain comprising the amino acid sequence of SEQ ID NO:411 and a variable light chain comprising the amino acid sequence of SEQ ID NO:413, a variable heavy chain comprising the amino acid sequence of SEQ ID NO:415 and a variable light chain comprising the amino acid sequence of SEQ ID NO:417, a variable heavy chain comprising the amino acid sequence of SEQ ID NO:419 and a variable light chain comprising the amino acid sequence of SEQ ID NO:421, a variable heavy chain comprising the amino acid sequence of SEQ ID NO:423 and a variable light chain comprising the amino acid sequence of SEQ ID NO:425, a variable heavy chain comprising the amino acid sequence of SEQ ID NO:427 and a variable light chain comprising the amino acid sequence of SEQ ID NO:429, a variable heavy chain comprising the amino acid sequence of SEQ ID NO:431 and a variable light chain comprising the amino acid sequence of SEQ ID NO:433, a variable heavy chain comprising the amino acid sequence of SEQ ID NO:435 and a variable light chain comprising the amino acid sequence of SEQ ID NO:437, a variable heavy chain comprising the amino acid sequence of SEQ ID NO:439 and a variable light chain comprising the amino acid sequence of SEQ ID NO:441, a variable heavy chain comprising the amino acid sequence of SEQ ID NO:443 and a variable light chain comprising the amino acid sequence of SEQ ID NO:445, a variable heavy chain comprising the amino acid sequence of SEQ ID NO:447 and a variable light chain comprising the amino acid sequence of SEQ ID NO:449, a variable heavy chain comprising the amino acid sequence of SEQ ID NO:451 and a variable light chain comprising the amino acid sequence of SEQ ID NO:453, a variable heavy chain comprising the amino acid sequence of SEQ ID NO:455 and a variable light chain comprising the amino acid sequence of SEQ ID NO:457, or a variable heavy chain comprising the amino acid sequence of SEQ ID NO:459 and a variable light chain comprising the amino acid sequence of SEQ ID NO:461.

In an embodiment of the invention, the binding molecules having SARS-CoV neutralizing activity are the binding molecules comprising at least a CDR3 region, preferably a heavy chain CDR3 region, comprising the amino acid sequence selected from the group consisting of SEQ ID NO:11 and SEQ ID NO:12. In a further embodiment, the binding molecules having SARS-CoV neutralizing activity are the binding molecules comprising a variable heavy chain comprising an amino acid sequence selected from the group consisting of SEQ ID NO:35 and SEQ ID NO:37. In yet a further embodiment, the binding molecules having SARS-CoV neutralizing activity are the binding molecules comprising a variable heavy chain comprising the amino acid sequence of SEQ ID NO:35 and a variable light chain comprising the amino acid sequence of SEQ ID NO:41 or a variable heavy chain comprising the amino acid sequence of SEQ ID NO:37 and a variable light chain comprising the amino acid sequence of SEQ ID NO:41. In a preferred embodiment the binding molecules having SARS-CoV neutralizing activity of the invention are administered in IgG1 or IgA (for instance for mucosal administration) format.

Another aspect of the invention includes functional variants of binding molecules as defined herein. Molecules are considered to be functional variants of a binding molecule according to the invention, if the variants are capable of competing for specifically binding to SARS-CoV or a fragment thereof with the parent binding molecules. In other words, when the functional variants are still capable of binding to SARS-CoV or a fragment thereof. Functional variants include, but are not limited to, derivatives that are substantially similar in primary structural sequence, but which contain e.g., in vitro or in vivo modifications, chemical and/or biochemical, that are not found in the parent binding molecule. Such modifications include inter alia acetylation, acylation, ADP-ribosylation, amidation, covalent attachment of flavin, covalent attachment of a heme moiety, covalent attachment of a nucleotide or nucleotide derivative, covalent attachment of a lipid or lipid derivative, covalent attachment of phosphotidylinositol, cross-linking, cyclization, disulfide bond formation, demethylation, formation of covalent cross-links, formation of cysteine, formation of pyroglutamate, formylation, gamma-carboxylation, glycosylation, GPI-anchor formation, hydroxylation, iodination, methylation, myristoylation, oxidation, pegylation, proteolytic processing, phosphorylation, prenylation, racemization, selenoylation, sulfation, transfer-RNA mediated addition of amino acids to proteins such as arginylation, ubiquitination, and the like.

Alternatively, functional variants can be binding molecules as defined in the present invention comprising an amino acid sequence containing substitutions, insertions, deletions or combinations thereof of one or more amino acids compared to the amino acid sequences of the parent binding molecules. Furthermore, functional variants can comprise truncations of the amino acid sequence at either or both the amino or carboxy termini. Functional variants according to the invention may have the same or different, either higher or lower, binding affinities compared to the parent binding molecule but are still capable of binding to SARS-CoV or a fragment thereof. For instance, functional variants according to the invention may have increased or decreased binding affinities for SARS-CoV or a fragment thereof compared to the parent binding molecules. Preferably, the amino acid sequences of the variable regions, including, but not limited to, framework regions, hypervariable regions, in particular the CDR3 regions, are modified. Generally, the light chain and the heavy chain variable regions comprise three hypervariable regions, comprising three CDRs, and more conserved regions, the so-called framework regions (FRs). The hypervariable regions comprise amino acid residues from CDRs and amino acid residues from hypervariable loops. Functional variants intended to fall within the scope of the present invention have at least about 50% to about 99%, preferably at least about 60% to about 99%, more preferably at least about 70% to about 99%, even more preferably at least about 80% to about 99%, most preferably at least about 90% to about 99%, in particular at least about 95% to about 99%, and in particular at least about 97% to about 99% amino acid sequence homology with the parent binding molecules as defined herein. Computer algorithms such as inter alia Gap or Bestfit known to a person skilled in the art can be used to optimally align amino acid sequences to be compared and to define similar or identical amino acid residues. Functional variants can be obtained by altering the parent binding molecules or parts thereof by general molecular biology methods known in the art including, but not limited to, error-prone PCR, oligonucleotide-directed mutagenesis and site-directed mutagenesis. Preferably, the functional variants of the invention have SARS-CoV neutralizing activity. This neutralizing activity may either be higher or be lower compared to the parent binding molecules. Furthermore, the functional variants may inhibit or down-regulate SARS-CoV replication, are complement fixing binding molecules capable of assisting in the lysis of enveloped SARS-CoV and/or act as opsonins and augment phagocytosis of SARS-CoV either by promoting its uptake via Fc or C3b receptors or by agglutinating SARS-CoV to make it more easily phagocytosed.

In yet a further aspect, the invention includes immunoconjugates, i.e., molecules comprising at least one binding molecule or functional variant thereof as defined herein and further comprising at least one tag, such as inter alia a detectable moiety/agent. Also contemplated in the present invention are mixtures of immunoconjugates according to the invention or mixtures of at least one immunoconjugates according to the invention and another molecule, such as a therapeutic agent or another binding molecule or immunoconjugate. In a further embodiment, the immunoconjugates of the invention may comprise more than one tag. These tags can be the same or distinct from each other and can be joined/conjugated non-covalently to the binding molecules. The tag(s) can also be joined/conjugated directly to the binding molecules through covalent bonding, including, but not limited to, disulfide bonding, hydrogen bonding, electrostatic bonding, recombinant fusion and conformational bonding. Alternatively, the tag(s) can be joined/conjugated to the binding molecules by means of one or more linking compounds. Techniques for conjugating tags to binding molecules are well known to the skilled artisan.

The tags of the immunoconjugates of the present invention may be therapeutic agents, but preferably they are detectable moieties/agents. Immunoconjugates comprising a detectable agent can be used diagnostically to, for example, assess if a subject has been infected with SARS-CoV or monitor the development or progression of a SARS-CoV infection as part of a clinical testing procedure to, e.g., determine the efficacy of a given treatment regimen. However, they may also be used for other detection and/or analytical and/or diagnostic purposes. Detectable moieties/agents include, but are not limited to, enzymes, prosthetic groups, fluorescent materials, luminescent materials, bioluminescent materials, radioactive materials, positron emitting metals, and nonradioactive paramagnetic metal ions.

The tags used to label the binding molecules for detection and/or analytical and/or diagnostic purposes depend on the specific detection/analysis/diagnosis techniques and/or methods used such as inter alia immunohistochemical staining of (tissue) samples, flow cytometric detection, scanning laser cytometric detection, fluorescent immunoassays, enzyme-linked immunosorbent assays (ELISAs), radioimmunoassays (RIAs), bioassays (e.g., neutralization assays), Western blotting applications, etc. For immunohistochemical staining of tissue samples preferred labels are enzymes that catalyze production and local deposition of a detectable product. Enzymes typically conjugated to binding molecules to permit their immunohistochemical visualization are well-known and include, but are not limited to, acetylcholinesterase, alkaline phosphatase, beta-galactosidase, glucose oxidase, horseradish peroxidase, and urease. Typical substrates for production and deposition of visually detectable products include, but are not limited to, o-nitrophenyl-beta-D-galactopyranoside (ONPG), o-phenylenediamine dihydrochloride (OPD), p-nitrophenyl phosphate (PNPP), p-nitrophenyl-beta-D-galactopryanoside (PNPG), 3', 3'-diaminobenzidine (DAB), 3-amino-9-ethylcarbazole (AEC), 4-chloro-1-naphthol (CN), 5-bromo-4-chloro-3-indolyl-phosphate (BCIP), ABTS, BluoGal, iodonitrotetrazolium (INT), nitroblue tetrazolium chloride (NBT), phenazine methosulfate (PMS), phenolphthalein monophosphate (PMP), tetramethyl benzidine (TMB), tetranitroblue tetrazolium (TNBT), X-Gal, X-Gluc, and X-glucoside. Other substrates that can be used to produce products for local deposition are luminescent substrates. For example, in the presence of hydrogen peroxide, horseradish peroxidase can catalyze the oxidation of cyclic diacylhydrazides such as luminol. Next to that, binding molecules of the immunoconjugate of the invention can also be labeled using colloidal gold or they can be labeled with radioisotopes, such as $^{33}P$, $^{32}P$, $^{35}S$, $^{3}H$, and $^{125}I$. Binding molecules of the invention can be attached to radionuclides directly or indirectly via a chelating agent by methods well known in the art.

When the binding molecules of the present invention are used for flow cytometric detections, scanning laser cytometric detections, or fluorescent immunoassays, they can usefully be labeled with fluorophores. A wide variety of fluorophores useful for fluorescently labeling the binding molecules of the present invention include, but are not limited to, Alexa Fluor and Alexa Fluor&commat dyes, BODIPY dyes, Cascade Blue, Cascade Yellow, Dansyl, lissamine rhodamine B, Marina Blue, Oregon Green 488, Oregon Green 514, Pacific Blue, rhodamine 6G, rhodamine green, rhodamine red, tetramethylrhodamine, Cy2, Cy3, Cy3.5, Cy5, Cy5.5, Cy7, fluorescein isothiocyanate (FITC), allophycocyanin (APC), R-phycoerythrin (PE), peridinin chlorophyll protein (PerCP), Texas Red, fluorescence resonance energy tandem fluorophores such as PerCP-Cy5.5, PE-Cy5, PE-Cy5.5, PE-Cy7, PE-Texas Red, and APC-Cy7. When the binding molecules of the present invention are used for secondary detection using labeled avidin, streptavidin, captavidin or neutravidin, the binding molecules may be labeled with biotin to form suitable prosthetic group complexes.

When the immunoconjugates of the invention are used for in vivo diagnostic use, the binding molecules can also be made detectable by conjugation to e.g., magnetic resonance imaging (MRI) contrast agents, such as gadolinium diethylenetriaminepentaacetic acid, to ultrasound contrast agents or to X-ray contrast agents, or by radioisotopic labeling.

A suitable luminescent material includes, but is not limited to, luminol and suitable bioluminescent materials include, but are not limited to, luciferase, luciferin, and aequorin.

Furthermore, the binding molecules, functional variants or immunoconjugates of the invention can also be attached to solid supports, which are particularly useful for in vitro immunoassays or purification of SARS-CoV or a fragment thereof. Such solid supports might be porous or nonporous, planar or nonplanar and include, but are not limited to, glass, cellulose, polyacrylamide, nylon, polystyrene, polyvinyl chloride or polypropylene supports. The binding molecules can also, for example, usefully be conjugated to filtration media, such as NHS-activated Sepharose or CNBr-activated Sepharose for purposes of immunoaffinity chromatography. They can also usefully be attached to paramagnetic microspheres, typically by biotin-streptavidin interaction. The microspheres can be used for isolation of SARS-CoV or a fragment thereof from a sample containing SARS-CoV or a fragment thereof. As another example, the binding molecules of the present invention can usefully be attached to the surface of a microtiter plate for ELISA.

The binding molecules of the present invention or functional fragments thereof can be fused to marker sequences, such as a peptide to facilitate purification. Examples include, but are not limited to, the hexa-histidine tag, the hemagglutinin (HA) tag, the myc tag or the flag tag.

Alternatively, an antibody can be conjugated to a second antibody to form an antibody heteroconjugate. In another aspect, the binding molecules of the invention may be conjugated/attached to one or more antigens. Preferably, these antigens are antigens which are recognized by the immune system of a subject to which the binding molecule-antigen conjugate is administered. The antigens may be identical but may also differ from each other. Conjugation methods for attaching the antigens and binding molecules are well known in the art and include, but are not limited to, the use of cross-linking agents. The binding molecules will bind to SARS-CoV and the antigens attached to the binding molecules will initiate a powerful T-cell attack on the conjugate which will eventually lead to the destruction of the SARS-CoV.

Next to producing immunoconjugates chemically by conjugating, directly or indirectly via for instance a linker, the immunoconjugates can be produced as fusion proteins comprising the binding molecules of the invention and a suitable tag. Fusion proteins can be produced by methods known in the art such as, e.g., recombinantly by constructing nucleic acid molecules comprising nucleotide sequences encoding the binding molecules in frame with nucleotide sequences encoding the suitable tag(s) and then expressing the nucleic acid molecules.

It is another aspect of the present invention to provide a nucleic acid molecule encoding at least a binding molecule or functional fragment thereof according to the invention. Such nucleic acid molecules can be used as intermediates for cloning purposes, e.g., in the process of affinity maturation described above. In a preferred embodiment, the nucleic acid molecules are isolated or purified.

The skilled man will appreciate that functional variants of these nucleic acid molecules are also intended to be a part of the present invention. Functional variants are nucleic acid sequences that can be directly translated, using the standard genetic code, to provide an amino acid sequence identical to that translated from the parent nucleic acid molecules.

Preferably, the nucleic acid molecules encode binding molecules comprising a CDR3 region, preferably a heavy chain CDR3 region, comprising an amino acid sequence selected from the group consisting of SEQ ID NO:1, SEQ ID NO:2, SEQ ID NO:3, SEQ ID NO:4, SEQ ID NO:5, SEQ ID NO:6, SEQ ID NO:7, SEQ ID NO:8, SEQ ID NO:9, SEQ ID NO:10, SEQ ID NO:11, SEQ ID NO:12, SEQ ID NO:13, SEQ ID NO:75, SEQ ID NO:76, SEQ ID NO:77, SEQ ID NO:78, SEQ ID NO:291, SEQ ID NO:292, SEQ ID NO:293, SEQ ID NO:294, SEQ ID NO:295, SEQ ID NO:296, SEQ ID NO:297, SEQ ID NO:298, SEQ ID NO:299, SEQ ID NO:300 and SEQ ID NO:301.

Even more preferably, the nucleic acid molecules encode binding molecules comprising a variable heavy chain comprising an amino acid sequence selected from the group consisting of SEQ ID NO:15, SEQ ID NO:17, SEQ ID NO:19, SEQ ID NO:21, SEQ ID NO:23, SEQ ID NO:25, SEQ ID NO:27, SEQ ID NO:29, SEQ ID NO:31, SEQ ID NO:33, SEQ ID NO:35, SEQ ID NO:37, SEQ ID NO:39, SEQ ID NO:80, SEQ ID NO:82, SEQ ID NO:84, SEQ ID NO:86, SEQ ID NO:303, SEQ ID NO:307, SEQ ID NO:311, SEQ ID NO:315, SEQ ID NO:319, SEQ ID NO:323, SEQ ID NO:327, SEQ ID NO:331, SEQ ID NO:335, SEQ ID NO:339, SEQ ID NO:343, SEQ ID NO:347, SEQ ID NO:351, SEQ ID NO:355, SEQ ID NO:359, SEQ ID NO:363, SEQ ID NO:367, SEQ ID NO:371, SEQ ID NO:375, SEQ ID NO:379, SEQ ID NO:383, SEQ ID NO:387, SEQ ID NO:391, SEQ ID NO:395, SEQ ID NO:399, SEQ ID NO:403, SEQ ID NO:407, SEQ ID NO:411, SEQ ID NO:415, SEQ ID NO:419, SEQ ID NO:423, SEQ ID NO:427, SEQ ID NO:431, SEQ ID NO:435, SEQ ID NO:439, SEQ ID NO:443, SEQ ID NO:447, SEQ ID NO:451, SEQ ID NO:455 and SEQ ID NO:459.

In yet another embodiment, the nucleic acid molecules encode binding molecules comprising a variable heavy chain comprising the amino acid sequence of SEQ ID NO:15 and a variable light chain comprising the amino acid sequence of SEQ ID NO:41, or they encode a variable heavy chain comprising the amino acid sequence of SEQ ID NO:17 and a variable light chain comprising the amino acid sequence of SEQ ID NO:41, or they encode a variable heavy chain comprising the amino acid sequence of SEQ ID NO:19 and a variable light chain comprising the amino acid sequence of SEQ ID NO:41, or they encode a variable heavy chain comprising the amino acid sequence of SEQ ID NO:21 and a variable light chain comprising the amino acid sequence of SEQ ID NO:41, or they encode a variable heavy chain comprising the amino acid sequence of SEQ ID NO:23 and a variable light chain comprising the amino acid sequence of SEQ ID NO:43, or they encode a variable heavy chain comprising the amino acid sequence of SEQ ID NO:25 and a variable light chain comprising the amino acid sequence of SEQ ID NO:41, or they encode a variable heavy chain comprising the amino acid sequence of SEQ ID NO:27 and a variable light chain comprising the amino acid sequence of SEQ ID NO:41, or they encode a variable heavy chain comprising the amino acid sequence of SEQ ID NO:29 and a variable light chain comprising the amino acid sequence of SEQ ID NO:41, or they encode a variable heavy chain comprising the amino acid sequence of SEQ ID NO:31 and a variable light chain comprising the amino acid sequence of SEQ ID NO:41, or they encode a variable heavy chain comprising the amino acid sequence of SEQ ID NO:33 and a variable light chain comprising the amino acid sequence of SEQ ID NO:45, or they encode a variable heavy chain comprising the amino acid sequence of SEQ ID NO:35 and a variable light chain comprising the amino acid sequence of SEQ ID NO:41, or they encode a variable heavy chain comprising the amino acid sequence of SEQ ID NO:37 and a variable light chain comprising the amino acid sequence of SEQ ID NO:41, or they encode a variable heavy chain comprising the amino acid sequence of SEQ ID NO:39 and a variable light chain comprising the amino acid sequence of SEQ ID NO:45, or they encode a variable heavy chain comprising the amino acid sequence of SEQ ID NO:80 and a variable light chain comprising the amino acid sequence of SEQ ID NO:41, or they encode a variable heavy chain comprising the amino acid sequence of SEQ ID NO:82 and a variable light chain comprising the amino acid sequence of SEQ ID NO:41, or they encode a variable heavy chain comprising the amino acid sequence of SEQ ID NO:84 and a variable light chain comprising the amino acid sequence of SEQ ID NO:88, or they encode a variable heavy chain comprising the amino acid sequence of SEQ ID NO:86 and a variable light chain comprising the amino acid sequence of SEQ ID NO:41, or they encode a variable heavy chain comprising the amino acid sequence of SEQ ID NO:303 and a variable light chain comprising the amino acid sequence of SEQ ID NO:305, or they encode a variable heavy chain comprising the amino acid sequence of SEQ ID NO:307 and a variable light chain comprising the amino acid sequence of SEQ ID NO:309, or they encode a variable heavy chain comprising the amino acid sequence of SEQ ID NO:311 and a variable light chain comprising the amino acid sequence of SEQ ID NO:313, or they encode a variable heavy chain comprising the amino acid sequence of SEQ ID NO:315 and a variable light chain comprising the amino acid sequence of SEQ ID NO:317, or they encode a variable heavy chain comprising the amino acid sequence of SEQ ID NO:319 and a variable light chain comprising the amino acid sequence of SEQ ID NO:321, or they encode a variable heavy chain comprising the amino acid sequence of SEQ ID NO:323 and a variable light chain comprising the amino acid sequence of SEQ ID NO:325, or they encode a variable heavy chain comprising the amino acid sequence of SEQ ID NO:327 and a variable light chain comprising the amino acid sequence of SEQ ID NO:329, or they encode a variable heavy chain comprising the amino acid sequence of SEQ ID NO:331 and a variable light chain comprising the amino acid sequence of SEQ ID NO:333, or they encode a variable heavy chain comprising the amino acid sequence of SEQ ID NO:335 and a variable light chain comprising the amino acid sequence of SEQ ID NO:337, or they encode a variable heavy chain comprising the amino acid sequence of SEQ ID NO:339 and a variable light chain comprising the amino acid sequence of SEQ ID NO:341, or they encode a variable heavy chain comprising the amino acid sequence of SEQ ID NO:343 and a variable light chain comprising the amino acid sequence of SEQ ID NO:345, or they encode a variable heavy chain comprising the amino acid sequence of SEQ ID NO:347 and a variable light chain comprising the amino acid sequence of SEQ ID NO:349, or they encode a variable heavy chain comprising the amino acid sequence of SEQ ID NO:351 and a variable light chain comprising the amino acid sequence of SEQ ID NO:353, or they encode a variable heavy chain comprising the amino acid sequence of SEQ ID NO:355 and a variable light chain comprising the amino acid sequence of SEQ ID NO:357, or they encode a variable heavy chain comprising the amino acid sequence of SEQ ID NO:359 and a variable light chain comprising the amino acid sequence of SEQ ID NO:361, or they encode a variable heavy chain comprising the amino acid sequence of SEQ ID NO:363 and a variable light chain comprising the amino acid sequence of SEQ ID NO:365, or they encode a variable heavy chain comprising the amino acid sequence of SEQ ID NO:367 and a variable light chain comprising the amino acid sequence of SEQ ID NO:369, or they encode a variable heavy chain comprising the amino acid sequence of SEQ ID NO:371 and a variable light chain comprising the amino acid sequence of SEQ ID NO:373, or they encode a variable heavy chain comprising the amino acid sequence of SEQ ID NO:375 and a variable light chain comprising the amino acid sequence of SEQ ID NO:377, or they encode a variable heavy chain comprising the amino acid sequence of SEQ ID NO:379 and a variable light chain comprising the amino acid sequence of SEQ ID NO:381, or they encode a variable heavy chain comprising the amino acid sequence of SEQ ID NO:383 and a variable light chain comprising the amino acid sequence of SEQ ID NO:385, or they encode a variable heavy chain comprising the amino acid sequence of SEQ ID NO:387 and a variable light chain comprising the amino acid sequence of SEQ ID NO:389, or they encode a variable heavy chain comprising the amino acid sequence of SEQ ID NO:391 and a variable light chain comprising the amino acid sequence of SEQ ID NO:393, or they encode a variable heavy chain comprising the amino acid sequence of SEQ ID NO:395 and a variable light chain comprising the amino acid sequence of SEQ ID NO:397, or they encode a variable heavy chain comprising the amino acid sequence of SEQ ID NO:399 and a variable light chain comprising the amino acid sequence of SEQ ID NO:401, or they encode a variable heavy chain comprising the amino acid sequence of SEQ ID NO:403 and a variable light chain comprising the amino acid sequence of SEQ ID NO:405, or they encode a variable heavy chain comprising the amino acid sequence of SEQ ID NO:407 and a variable light chain comprising the amino acid sequence of SEQ ID NO:409, or they encode a variable heavy chain comprising the amino acid sequence of SEQ ID NO:411 and a variable light chain comprising the amino acid sequence of SEQ ID NO:413, or they encode a variable heavy chain comprising the amino acid sequence of SEQ ID NO:415 and a variable light chain comprising the amino acid sequence of SEQ ID NO:417, or they encode a variable heavy chain comprising the amino acid sequence of SEQ ID NO:419 and a variable light chain comprising the amino acid sequence of SEQ ID NO:421, or they encode a variable heavy chain comprising the amino acid sequence of SEQ ID NO:423 and a variable light chain comprising the amino acid sequence of SEQ ID NO:425, or they encode a variable heavy chain comprising the amino acid sequence of SEQ ID NO:427 and a variable light chain comprising the amino acid sequence of SEQ ID NO:429, or they encode a variable heavy chain comprising the amino acid sequence of SEQ ID NO:431 and a variable light chain comprising the amino acid sequence of SEQ ID NO:433, or they encode a variable heavy chain comprising the amino acid sequence of SEQ ID NO:435 and a variable light chain comprising the amino acid sequence of SEQ ID NO:437, or they encode a variable heavy chain comprising the amino acid sequence of SEQ ID NO:439 and a variable light chain comprising the amino acid sequence of SEQ ID NO:441, or they encode a variable heavy chain comprising the amino acid sequence of SEQ ID NO:443 and a variable light chain comprising the amino acid sequence of SEQ ID NO:445, or they encode a variable heavy chain comprising the amino acid sequence of SEQ ID NO:447 and a variable light chain comprising the amino acid sequence of SEQ ID NO:449, or they encode a variable heavy chain comprising the amino acid sequence of SEQ ID NO:451 and a variable light chain comprising the amino acid sequence of SEQ ID NO:453, or they encode a variable heavy chain comprising the amino acid sequence of SEQ ID NO:455 and a variable light chain comprising the amino acid sequence of SEQ ID NO:457, or they encode a variable heavy chain comprising the amino acid sequence of SEQ ID NO:459 and a variable light chain comprising the amino acid sequence of SEQ ID NO:461.

In a specific embodiment of the invention, the nucleic acid molecules encoding the variable heavy chain of the binding molecules of the invention comprise a nucleotide sequence selected from the group consisting of SEQ ID NO:14, SEQ ID NO:16, SEQ ID NO:18, SEQ ID NO:20, SEQ ID NO:22, SEQ ID NO:24, SEQ ID NO:26, SEQ ID NO:28, SEQ ID NO:30, SEQ ID NO:32, SEQ ID NO:34, SEQ ID NO:36, SEQ ID NO:38, SEQ ID NO:79, SEQ ID NO:81, SEQ ID NO:83, SEQ ID NO:85, SEQ ID NO:302, SEQ ID NO:306, SEQ ID NO:310, SEQ ID NO:314, SEQ ID NO:318, SEQ ID NO:322, SEQ ID NO:326, SEQ ID NO:330, SEQ ID NO:334, SEQ ID NO:338, SEQ ID NO:342, SEQ ID NO:346, SEQ ID NO:350, SEQ ID NO:354, SEQ ID NO:358, SEQ ID NO:362, SEQ ID NO:366, SEQ ID NO:370, SEQ ID NO:374, SEQ ID NO:378, SEQ ID NO:382, SEQ ID NO:386, SEQ ID NO:390, SEQ ID NO:394, SEQ ID NO:398, SEQ ID NO:402, SEQ ID NO:406, SEQ ID NO:410, SEQ ID NO:414, SEQ ID NO:418, SEQ ID NO:422, SEQ ID NO:426, SEQ ID NO:430, SEQ ID NO:434, SEQ ID NO:438, SEQ ID NO:442, SEQ ID NO:446, SEQ ID NO:450, SEQ ID NO:454 and SEQ ID NO:458.

In yet another specific embodiment of the present invention, the nucleic acid molecules encoding the variable light chain of the binding molecules of the invention comprise a nucleotide sequence selected of the group consisting of SEQ ID NO:40, SEQ ID NO:42, SEQ ID NO:44, SEQ ID NO:87, SEQ ID NO:304, SEQ ID NO:308, SEQ ID NO:312, SEQ ID NO:316, SEQ ID NO:320, SEQ ID NO:324, SEQ ID NO:328, SEQ ID NO:332, SEQ ID NO:336, SEQ ID NO:340, SEQ ID NO:344, SEQ ID NO:348, SEQ ID NO:352, SEQ ID NO:356, SEQ ID NO:360, SEQ ID NO:364, SEQ ID NO:368, SEQ ID NO:372, SEQ ID NO:376, SEQ ID NO:380, SEQ ID NO:384, SEQ ID NO:388, SEQ ID NO:392, SEQ ID NO:396, SEQ ID NO:400, SEQ ID NO:404, SEQ ID NO:408, SEQ ID NO:412, SEQ ID NO:416, SEQ ID NO:420, SEQ ID NO:424, SEQ ID NO:428, SEQ ID NO:432, SEQ ID NO:436, SEQ ID NO:440, SEQ ID NO:444, SEQ ID NO:448, SEQ ID NO:452, SEQ ID NO:456 and SEQ ID NO:460.

It is another aspect of the invention to provide vectors, i.e., nucleic acid constructs, comprising one or more nucleic acid molecules according to the present invention. Vectors can be derived from plasmids such as inter alia F, R1, RP1, Col, pBR322, TOL, Ti, etc; cosmids; phages such as lambda, lambdoid, M13, Mu, P1, P22, Q$_\beta$, T-even, T-odd, T2, T4, T7, etc; plant viruses such as inter alia alfalfa mosaic virus, bromovirus, capillovirus, carlavirus, carmovirus, caulivirus, clostervirus, comovirus, cryptovirus, cucumovirus, dianthovirus, fabavirus, fijivirus, furovirus, geminivirus, hordeivirus, ilarvirus, luteovirus, machlovirus, marafivirus, necrovirus, nepovirus, phytorepvirus, plant rhabdovirus, potexvirus, potyvirus, sobemovirus, tenuivirus, tobamovirus, tobravirus, tomato spotted wilt virus, tombusvirus, tymovirus, etc.; or animal viruses such as inter alia adenovirus, arenaviridae, baculoviridae, bimaviridae, bunyaviridae, calciviridae, cardioviruses, coronaviridae, corticoviridae, cystoviridae, Epstein-Barr virus, enteroviruses, filoviridae, flaviviridae, Foot-and-Mouth disease virus, hepadnaviridae, hepatitis viruses, herpesviridae, immunodeficiency viruses, influenza virus, inoviridae, iridoviridae, orthomyxoviridae, papovaviruses, paramyxoviridae, parvoviridae, picornaviridae, poliovirus, polydnaviridae, poxyiridae, reoviridae, retroviruses, rhabdoviridae, rhinoviruses, Semliki Forest virus, tetraviridae, togaviridae, toroviridae, vaccinia virus, vescular stomatitis virus, etc. Vectors can be used for cloning and/or for expression of the binding molecules of the invention and might even be used for gene therapy purposes. Vectors comprising one or more nucleic acid molecules according to the invention operably linked to one or more expression-regulating nucleic acid molecules are also covered by the present invention. The choice of the vector is dependent on the recombinant procedures followed and the host used. Introduction of vectors in host cells can be effected by inter alia calcium phosphate transfection, virus infection, DEAE-dextran mediated transfection, lipofectamin transfection or electroporation. Vectors may be autonomously replicating or may replicate together with the chromosome into which they have been integrated. Preferably, the vectors contain one or more selection markers. The choice of the markers may depend on the host cells of choice, although this is not critical to the invention as is well known to persons skilled in the art. They include, but are not limited to, kanamycin, neomycin, puromycin, hygromycin, zeocin, thymidine kinase gene from Herpes simplex virus (HSV-TK), dihydrofolate reductase gene from mouse (dhfr). Vectors comprising one or more nucleic acid molecules encoding the binding molecules as described above operably linked to one or more nucleic acid molecules encoding proteins or peptides that can be used to isolate the binding molecules are also covered by the invention. These proteins or peptides include, but are not limited to, glutathione-S-transferase, maltose binding protein, metal-binding polyhistidine, green fluorescent protein, luciferase and beta-galactosidase.

Hosts containing one or more copies of the vectors mentioned above are an additional subject of the present invention. Preferably, the hosts are host cells. Host cells include, but are not limited to, cells of mammalian, plant, insect, fungal or bacterial origin. Bacterial cells include, but are not limited to, cells from Gram positive bacteria such as several species of the genera *Bacillus, Streptomyces* and *Staphylococcus* or cells of Gram negative bacteria such as several species of the genera *Escherichia*, such as *E. coli*, and *Pseudomonas*. In the group of fungal cells preferably yeast cells are used. Expression in yeast can be achieved by using yeast strains such as inter alia *Pichia pastoris, Saccharomyces cerevisiae* and *Hansenula polymorpha*. Furthermore, insect cells such as cells from *Drosophila* and Sf9 can be used as host cells. Besides that, the host cells can be plant cells such as inter alia cells from crop plants such as forestry plants, or cells from plants providing food and raw materials such as cereal plants, or medicinal plants, or cells from ornamentals, or cells from flower bulb crops. Transformed (transgenic) plants or plant cells are produced by known methods, for example, *Agrobacterium*-mediated gene transfer, transformation of leaf discs, protoplast transformation by polyethylene glycol-induced DNA transfer, electroporation, sonication, microinjection or bolistic gene transfer. Additionally, a suitable expression system can be a baculovirus system. Expression systems using mammalian cells such as Chinese Hamster Ovary (CHO) cells, COS cells, BHK cells or Bowes melanoma cells are preferred in the present invention. Mammalian cells provide expressed proteins with posttranslational modifications that are most similar to natural molecules of mammalian origin. Since the present invention deals with molecules that may have to be administered to humans, a completely human expression system would be particularly preferred. Therefore, even more preferably, the host cells are human cells. Examples of human cells are inter alia HeLa, 911, AT1080, A549, 293 and HEK293T cells. Preferred mammalian cells are human retina cells such as 911 cells or the cell line deposited at the European Collection of Cell Cultures (ECACC), CAMR, Salisbury, Wiltshire SP4 OJG, Great Britain on 29 Feb. 1996 under number 96022940 and marketed under the trademark PER.C6® (PER.C6 is a registered trademark of Crucell Holland B.V.). For the purposes of this application "PER.C6" refers to cells deposited under number 96022940 or ancestors, passages up-stream or down-stream as well as descendants from ancestors of deposited cells, as well as derivatives of any of the foregoing.

In preferred embodiments, the human producer cells comprise at least a functional part of a nucleic acid sequence encoding an adenovirus E1 region in expressible format. In even more preferred embodiments, the host cells are derived from a human retina and immortalized with nucleic acids comprising adenoviral E1 sequences, such as the cell line deposited at the European Collection of Cell Cultures (ECACC), CAMR, Salisbury, Wiltshire SP4 OJG, Great Britain on 29 Feb. 1996 under number 96022940 and marketed under the trademark PER.C6™, and derivatives thereof. Production of recombinant proteins in host cells can be performed according to methods well known in the art. The use of the cells marketed under the trademark PER.C6™ as a production platform for proteins of interest has been described in WO 00/63403 the disclosure of which is incorporated herein by reference in its entirety.

A method of producing a binding molecule or a functional variant according to the invention is an additional part of the invention. The method comprises the steps of a) culturing a host according to the invention under conditions conducive to the expression of the binding molecule or functional variant, and b) optionally, recovering the expressed binding molecule or functional variant. The expressed binding molecules or functional variants thereof can be recovered from the cell free extract, but preferably they are recovered from the culture medium. Methods to recover proteins, such as binding molecules, from cell free extracts or culture medium are well known to the man skilled in the art. Binding molecules or functional variants thereof as obtainable by the above-described method are also a part of the present invention.

Alternatively, next to the expression in hosts, such as host cells, the binding molecules or functional variants thereof of the invention can be produced synthetically by conventional peptide synthesizers or in cell-free translation systems using RNA nucleic acid derived from DNA molecules according to the invention. Binding molecule or functional variants thereof as obtainable by the above-described synthetic production methods or cell-free translation systems are also a part of the present invention.

In yet another embodiment, human binding molecules of the present invention can also be produced in transgenic, non-human, mammals such as inter alia rabbits, goats or cows, and secreted into for instance the milk thereof.

In yet another alternative embodiment, binding molecules according to the present invention, preferably human binding molecules specifically binding to SARS-CoV or a fragment thereof, may be generated by transgenic non-human mammals, such as for instance transgenic mice or rabbits, that express human immunoglobulin genes. Preferably, the transgenic non-human mammals have a genome comprising a human heavy chain transgene and a human light chain transgene encoding all or a portion of the human binding molecules as described above. The transgenic non-human mammals can be immunized with a purified or enriched preparation of SARS-CoV or a fragment thereof. Protocols for immunizing non-human mammals are well established in the art. See Using Antibodies: A Laboratory Manual, Edited by: E. Harlow, D. Lane (1998), Cold Spring Harbor Laboratory, Cold Spring Harbor, N.Y. and Current Protocols in Immunology, Edited by: J. E. Coligan, A. M. Kruisbeek, D. H. Margulies, E. M. Shevach, W. Strober (2001), John Wiley & Sons Inc., New York, the disclosures of which are incorporated herein by reference. Immunization protocols often include multiple immunizations, either with or without adjuvants such as Freund's complete adjuvant and Freund's incomplete adjuvant, but may also include naked DNA immunizations. In another embodiment, the human binding molecules are produced by B cells or plasma cells derived from the transgenic animals. In yet another embodiment, the human binding molecules are produced by hybridomas which are prepared by fusion of B cells obtained from the above-described transgenic non-human mammals to immortalized cells. B cells, plasma cells and hybridomas as obtainable from the above-described transgenic non-human mammals and human binding molecules as obtainable from the above-described transgenic non-human mammals, B cells, plasma cells and hybridomas are also a part of the present invention.

In a further aspect, the invention provides a method of identifying binding molecules, preferably human binding molecules such as human monoclonal antibodies or fragments thereof, according to the invention, or nucleic acid molecules according to the invention, and comprises the steps of a) contacting a phage library of binding molecules, preferably human binding molecules, with SARS-CoV or a fragment thereof, b) selecting at least once for a phage binding to the SARS-CoV or the fragment thereof, and c) separating and recovering the phage binding to the SARS-CoV or the fragment thereof. The selection step according to the present invention is preferably performed in the presence of SARS-CoV which is inactivated. The SARS-CoV may be isolated or non-isolated, e.g., present in serum and/or blood of an infected individual. Alternatively, the selection step may be performed in the presence of a fragment of SARS-CoV such as an extracellular part of the SARS-CoV, one or more proteins or (poly)peptides derived from SARS-CoV, fusion proteins comprising these proteins or (poly)peptides, and the like. Phage display methods for identifying and obtaining binding molecules, e.g., antibodies, are by now well-established methods known by the person skilled in the art. They are e.g., described in U.S. Pat. No. 5,696,108; Burton and Barbas, 1994; de Kruif et al., 1995b; and Phage Display: A Laboratory Manual. Edited by: C. F. Barbas, D. R. Burton, J. K. Scott and G. J. Silverman (2001), Cold Spring Harbor Laboratory Press, Cold Spring Harbor, N.Y. All these references are herewith incorporated herein in their entirety. For the construction of phage display libraries, collections of human monoclonal antibody heavy and light chain variable region genes are expressed on the surface of bacteriophage, preferably filamentous bacteriophage, particles, in, for example, single-chain Fv (scFv) or in Fab format (see de Kruif et al., 1995b). Large libraries of antibody fragment-expressing phages typically contain more than $1.0*10^9$ antibody specificities and may be assembled from the immunoglobulin V regions expressed in the B lymphocytes of immunized- or non-immunized individuals. In a specific embodiment of the invention, the phage library of binding molecules, preferably scFv phage library, is prepared from RNA isolated from cells obtained from a subject that has been vaccinated or exposed to a SARS-CoV. RNA can be isolated from inter alia bone marrow or peripheral blood, preferably peripheral blood lymphocytes. The subject can be an animal vaccinated or exposed to SARS-CoV, but is preferably a human subject which has been vaccinated or has been exposed to SARS-CoV. Preferably the human subject has recovered from SARS-CoV.

Alternatively, phage display libraries may be constructed from immunoglobulin variable regions that have been partially assembled in vitro to introduce additional antibody diversity in the library (semi-synthetic libraries). For example, in vitro assembled variable regions contain stretches of synthetically produced, randomized or partially randomized DNA in those regions of the molecules that are important for antibody specificity, e.g., CDR regions. SARS-CoV specific phage antibodies can be selected from the library by immobilizing target antigens such as antigens from SARS-CoV on a solid phase and subsequently exposing the target antigens to a phage library to allow binding of phages expressing antibody fragments specific for the solid phase-bound antigen(s). Non-bound phages are removed by washing and bound phages eluted from the solid phase for infection of Escherichia coli (E. coli) bacteria and subsequent propagation. Multiple rounds of selection and propagation are usually required to sufficiently enrich for phages binding specifically to the target antigen(s). If desired, before exposing the phage library to target antigens the phage library can first be subtracted by exposing the phage library to non-target antigens bound to a solid phase. Phages may also be selected for binding to complex antigens such as complex mixtures of SARS-CoV proteins or (poly)peptides, host cells expressing one or more proteins or (poly)peptides of SARS-CoV, or SARS-CoV itself. Antigen specific phage antibodies can be selected from the library by incubating a solid phase with bound thereon a preparation of inactivated SARS-CoV with the phage antibody library to let, for example, the scFv or Fab part of the phage bind to the proteins/polypeptides of the SARS-CoV preparation. After incubation and several washes to remove unbound and loosely attached phages, the phages that have bound with their scFv or Fab part to the preparation are eluted and used to infect *Escherichia coli* to allow amplification of the new specificity. Generally, one or more selection rounds are required to separate the phages of interest from the large excess of non-binding phages. Alternatively, known proteins or (poly)peptides of the SARS-CoV can be expressed in host cells and these cells can be used for selection of phage antibodies specific for the proteins or (poly) peptides. A phage display method using these host cells can be extended and improved by subtracting non-relevant binders during screening by addition of an excess of host cells comprising no target molecules or non-target molecules that are similar, but not identical, to the target, and thereby strongly enhance the chance of finding relevant binding molecules. (This process is referred to as the MABSTRACT™ process. MABSTRACT™ is a pending trademark application of Crucell Holland B.V., see also U.S. Pat. No. 6,265,150 which is incorporated herein by reference.)

In yet a further aspect, the invention provides a method of obtaining a binding molecule, preferably a human binding molecule or a nucleic acid molecule according to the invention, wherein the method comprises the steps of a) performing the above-described method of identifying binding molecules, preferably human binding molecules such as human monoclonal antibodies or fragments thereof according to the invention, or nucleic acid molecules according to the invention, and b) isolating from the recovered phage the human binding molecule and/or the nucleic acid encoding the human binding molecule. Once a new monoclonal phage antibody has been established or identified with the above mentioned method of identifying binding molecules or nucleic acid molecules encoding the binding molecules, the DNA encoding the scFv or Fab can be isolated from the bacteria or phages and combined with standard molecular biological techniques to make constructs encoding bivalent scFvs or complete human immunoglobulins of a desired specificity (e.g., IgG, IgA or IgM). These constructs can be transfected into suitable cell lines and complete human monoclonal antibodies can be produced (see Huls et al., 1999; Boel et al., 2000).

In a further aspect, the invention is directed to a phage library of binding molecules, preferably a scFv phage display library which is prepared from RNA isolated from cells obtained from a subject that has been vaccinated or exposed to a SARS-CoV. RNA can be isolated from inter alia bone marrow or peripheral blood, preferably peripheral blood lymphocytes. The subject can be an animal vaccinated or exposed to SARS-CoV, but is preferably a human subject which has been vaccinated or has been exposed to SARS-CoV. Preferably the human subject has recovered from SARS-CoV.

In yet a further aspect, the invention provides compositions comprising at least one binding molecule, at least one functional variant or fragment thereof, at least one immunoconjugate according to the invention or a combination thereof. In addition to that, the compositions may comprise inter alia stabilizing molecules, such as albumin or polyethylene glycol, or salts. Preferably, the salts used are salts that retain the desired biological activity of the binding molecules and do not impart any undesired toxicological effects. Examples of such salts include, but are not limited to, acid addition salts and base addition salts. Acid addition salts include, but are not limited to, those derived from nontoxic inorganic acids, such as hydrochloric, nitric, phosphoric, sulfuric, hydrobromic, hydroiodic, phosphorous and the like, as well as from nontoxic organic acids such as aliphatic mono- and dicarboxylic acids, phenyl-substituted alkanoic acids, hydroxy alkanoic acids, aromatic acids, aliphatic and aromatic sulfonic acids and the like. Base addition salts include, but are not limited to, those derived from alkaline earth metals, such as sodium, potassium, magnesium, calcium and the like, as well as from nontoxic organic amines, such as N,N'-dibenzylethylenediamine, N-methylglucamine, chloroprocaine, choline, diethanolamine, ethylenediamine, procaine and the like. If necessary, the binding molecules of the invention may be coated in or on a material to protect them from the action of acids or other natural or non-natural conditions that may inactivate the binding molecules.

In yet a further aspect, the invention provides compositions comprising at least one nucleic acid molecule as defined in the present invention. The compositions may comprise aqueous solutions such as aqueous solutions containing salts (e.g., NaCl or salts as described above), detergents (e.g., SDS) and/or other suitable components.

Furthermore, the present invention pertains to pharmaceutical compositions comprising at least one binding molecule according to the invention, at least one functional variant or fragment thereof, at least one immunoconjugate according to the invention, at least one composition according to the invention, or combinations thereof. The pharmaceutical composition of the invention further comprises at least one pharmaceutically acceptable excipient.

A pharmaceutical composition according to the invention can further comprise at least one other therapeutic, prophylactic and/or diagnostic agent. Preferably, the pharmaceutical composition comprises at least one other prophylactic and/or therapeutic agent. Preferably, the further therapeutic and/or prophylactic agents are agents capable of preventing and/or treating an infection and/or a condition resulting from SARS-CoV. Therapeutic and/or prophylactic agents include, but are not limited to, anti-viral agents. Such agents can be binding molecules, small molecules, organic or inorganic compounds, enzymes, polynucleotide sequences etc.

Examples of anti-viral agents include, but are not limited to, abacavir, acyclovir, adefovir, afovirsen, amantadine, amprenavir, AZT, camptothecins, castanospermine, cidofovir, D4T, ddC, ddI, d4T, delavirdine, didanosine, efavirenz, famciclovir, fialuridine, foscarnet, FTC, ganciclovir, GG167, idoxuridine, indinavir, interferon alpha, lamivudine, lobucavir, loviride, nelfinavir, nevirapine, oseltamivir, penciclovir, pirodavir, ribavirin, rimantadine, ritonavir, saquinavir, sICAM-1, sorivudine, stavudine, trifluridine, 3TC, valacyclovir, vidarabine, zalcitabine, zanamivir, zidovudine, and pharmaceutically acceptable salts, acids or derivatives of any of the above. Other agents that are currently used to treat patients infected with SARS-CoV are interferon-alpha, steroids and potential replicase inhibitors. Furthermore, patients infected with SARS-CoV are currently treated by transfusion of serum produced from blood donated by recovering/recovered SARS patients who have produced antibodies after being exposed to the virus. Agents capable of preventing and/or treating an infection with SARS-CoV and/or a condition resulting from SARS-CoV that are in the experimental phase might also be used as other therapeutic and/or prophylactic agents useful in the present invention.

The binding molecules of the invention or pharmaceutical compositions of the invention can be tested in suitable animal model systems prior to use in humans. Such animal model systems include, but are not limited to, mice, rats, chicken, cows, monkeys, pigs, dogs, rabbits, etc. Any animal system well-known in the art may be used.

Typically, pharmaceutical compositions must be sterile and stable under the conditions of manufacture and storage. The binding molecules, variant or fragments thereof, immunoconjugates, nucleic acid molecules or compositions of the present invention can be in powder form for reconstitution in the appropriate pharmaceutically acceptable excipient before or at the time of delivery. In the case of sterile powders for the preparation of sterile injectable solutions, the preferred methods of preparation are vacuum drying and freeze-drying (lyophilization) that yield a powder of the active ingredient plus any additional desired ingredient from a previously sterile-filtered solution thereof.

Alternatively, the binding molecules, variant or fragments thereof, immunoconjugates, nucleic acid molecules or compositions of the present invention can be in solution and the appropriate pharmaceutically acceptable excipient can be added and/or mixed before or at the time of delivery to provide a unit dosage injectable form. Preferably, the pharmaceutically acceptable excipient used in the present invention is suitable to high drug concentration, can maintain proper fluidity and, if necessary, can delay absorption.

The choice of the optimal route of administration of the pharmaceutical compositions will be influenced by several factors including the physico-chemical properties of the active molecules within the compositions, the urgency of the clinical situation and the relationship of the plasma concentrations of the active molecules to the desired therapeutic effect. For instance, if necessary, the binding molecules of the invention can be prepared with carriers that will protect them against rapid release, such as a controlled release formulation, including implants, transdermal patches, and microencapsulated delivery systems. Biodegradable, biocompatible polymers can inter alia be used, such as ethylene vinyl acetate, polyanhydrides, polyglycolic acid, collagen, polyorthoesters, and polylactic acid. Furthermore, it may be necessary to coat the binding molecules with, or co-administer the binding molecules with, a material or compound that prevents the inactivation of the binding molecules. For example, the binding molecules may be administered to a subject in an appropriate carrier, for example, liposomes, or a diluent.

The routes of administration can be divided into two main categories, oral and parenteral administration. These two categories include, but are not limited to, bolus, buccal, epidermal, epidural, inhalation, intra-abdominal, intra-arterial, intra-articular, intrabronchial, intracapsular, intracardiac, intracartilaginous, intracavitary, intracelial, intracelebellar, intracerebronventricular, intracolic, intracervical, intradermal, intragastric, intrahepatic, intramedullary, intramuscular, intramyocardial, intranasal, intra-ocular intra-orbital, intraosteal, intrapelvic, intrapericardiac, intraperitoneal, intraplaque, intrapleural, intraprostatic, intrapulmonary, intrarectal, intrarenal, intraretinal, intraspinal, intrasternal, intrasynovial, intrathecal, intrathoracic, intratumoral, intrauterine, intravenous, intraventricular, intravesical, rectal, spinal, subarachnoid, subcapsular, subcutaneous, subcuticular, sublingual, topical, transdermal, transmucosal, transtracheal, and vaginal administration. The preferred administration route is intravenous, particularly preferred is intramuscular.

Oral dosage forms can be formulated inter alia as tablets, troches, lozenges, aqueous or oily suspensions, dispersible powders or granules, emulsions, hard capsules, soft gelatin capsules, syrups or elixirs, pills, dragees, liquids, gels, or slurries. These formulations can contain pharmaceutically excipients including, but not limited to, inert diluents such as calcium carbonate, sodium carbonate, lactose, calcium phosphate or sodium phosphate; granulating and disintegrating agents such as corn starch or alginic acid; binding agents such as starch, gelatin or acacia; lubricating agents such as calcium stearate, glyceryl behenate, hydrogenated vegetable oils, magnesium stearate, mineral oil, polyethylene glycol, sodium stearyl, fumarate, stearic acid, talc, zinc stearate; preservatives such as n-propyl-p-hydroxybenzoate; coloring, flavoring or sweetening agents such as sucrose, saccharine, glycerol, propylene glycol or sorbitol; vegetable oils such as arachis oil, olive oil, sesame oil or coconut oil; mineral oils such as liquid paraffin; wetting agents such as benzalkonium chloride, docusate sodium, lecithin, poloxamer, sodium lauryl sulfate, sorbitan esters; and thickening agents such as agar, alginic acid, beeswax, carboxymethyl cellulose calcium, carageenan, dextrin or gelatin.

The pharmaceutical compositions of the present invention can also be formulated for parenteral administration. Formulations for parenteral administration can be inter alia in the form of aqueous or non-aqueous isotonic sterile non-toxic injection or infusion solutions or suspensions. Preferred parenteral administration routes include intravenous, intraperitoneal, epidural, intramuscular and intratumoral injection or infusion. The solutions or suspensions may comprise agents that are non-toxic to recipients at the dosages and concentrations employed such as 1,3-butanediol, Ringer's solution, Hank's solution, isotonic sodium chloride solution, oils such as synthetic mono- or diglycerides or fatty acids such as oleic acid, local anesthetic agents, preservatives, buffers, viscosity or solubility increasing agents, water-soluble antioxidants such as ascorbic acid, cysteine hydrochloride, sodium bisulfate, sodium metabisulfite, sodium sulfite and the like, oil-soluble antioxidants such as ascorbyl palmitate, butylated hydroxyanisole (BHA), butylated hydroxytoluene (BHT), lecithin, propyl gallate, alpha-tocopherol, and the like, and metal chelating agents, such as citric acid, ethylenediamine tetraacetic acid (EDTA), sorbitol, tartaric acid, phosphoric acid, and the like.

In a further aspect, the binding molecules, functional variants, immunoconjugates, compositions, or pharmaceutical compositions of the invention can be used as a medicament. So, a method of treatment and/or prevention of a SARS-CoV infection using the binding molecules, functional variants, immunoconjugates, compositions, or pharmaceutical compositions of the invention is another part of the present invention. The above-mentioned molecules can inter alia be used in the diagnosis, prophylaxis, treatment, or combination thereof, of one or more conditions resulting from SARS-CoV. They are suitable for treatment of yet untreated patients suffering from a condition resulting from SARS-CoV and patients who have been or are treated from a condition resulting from SARS-CoV. They protect against further infection by SARS-CoV and/or will retard the onset or progress of the symptoms associated with SARS. They may even be used in the prophylaxis of SARS in for instance people exposed to the SARS-CoV such as hospital personnel taking care of suspected SARS patients.

The above-mentioned molecules or compositions may be employed in conjunction with other molecules useful in diagnosis, prophylaxis and/or treatment. They can be used in vitro, ex vivo or in vivo. For instance, the binding molecules, functional variants, immunoconjugates or pharmaceutical compositions of the invention can be co-administered with a vaccine against SARS-CoV. Alternatively, the vaccine may also be administered before or after administration of the molecules of the invention. Administration of the molecules of the invention with a vaccine might be suitable for post-exposure prophylaxis and might also decrease possible side effects of a live-attenuated vaccine in immunocompromised recipients.

The molecules are typically formulated in the compositions and pharmaceutical compositions of the invention in a therapeutically or diagnostically effective amount. Dosage regimens can be adjusted to provide the optimum desired response (e.g., a therapeutic response). A suitable dosage range may for instance be 0.1-100 mg/kg body weight, preferably 0.5-15 mg/kg body weight. Furthermore, for example, a single bolus may be administered, several divided doses may be administered over time or the dose may be proportionally reduced or increased as indicated by the exigencies of the therapeutic situation. The molecules and compositions according to the present invention are preferably sterile. Methods to render these molecules and compositions sterile are well known in the art. The other molecules useful in diagnosis, prophylaxis and/or treatment can be administered in a similar dosage regimen as proposed for the binding molecules of the invention. If the other molecules are administered separately, they may be administered to a patient prior to (e.g., 2 minutes, 5 minutes, 10 minutes, 15 minutes, 30 minutes, 45 minutes, 60 minutes, 2 hours, 4 hours, 6 hours, 8 hours, 10 hours, 12 hours, 14 hours, 16 hours, 18 hours, 20 hours, 22 hours, 24 hours, 2 days, 3 days, 4 days, 5 days, 7 days, 2 weeks, 4 weeks or 6 weeks before), concomitantly with, or subsequent to (e.g., 2 minutes, 5 minutes, 10 minutes, 15 minutes, 30 minutes, 45 minutes, 60 minutes, 2 hours, 4 hours, 6 hours, 8 hours, 10 hours, 12 hours, 14 hours, 16 hours, 18 hours, 20 hours, 22 hours, 24 hours, 2 days, 3 days, 4 days, 5 days, 7 days, 2 weeks, 4 weeks or 6 weeks after) the administration of one or more of the binding molecules or pharmaceutical compositions of the invention. The exact dosing regimen is usually sorted out during clinical trials in human patients.

Human binding molecules and pharmaceutical compositions comprising the human binding molecules are particularly useful, and often preferred, when to be administered to human beings as in vivo therapeutic agents, since recipient immune response to the administered antibody will often be substantially less than that occasioned by administration of a monoclonal murine, chimeric or humanized binding molecule.

In another aspect, the invention concerns the use of binding molecules, preferably human binding molecules, functional variants thereof, immunoconjugates according to the invention, nucleic acid molecules according to the invention, compositions or pharmaceutical compositions according to the invention in the preparation of a medicament for the diagnosis, prophylaxis, treatment, or combination thereof, of a condition resulting from SARS-CoV.

Next to that, kits comprising at least one binding molecule, preferably human binding molecule, according to the invention, at least one functional variant thereof according to the invention, at least one immunoconjugate according to the invention, at least one nucleic acid molecule according to the invention, at least one composition according to the invention, at least one pharmaceutical composition according to the invention, at least one vector according to the invention, at least one host according to the invention or a combination thereof are also a part of the present invention. Optionally, the above-described components of the kits of the invention are packed in suitable containers and labeled for diagnosis, prophylaxis and/or treatment of the indicated conditions. The above-mentioned components may be stored in unit or multi-dose containers, for example, sealed ampules, vials, bottles, syringes, and test tubes, as an aqueous, preferably sterile, solution or as a lyophilized, preferably sterile, formulation for reconstitution. The containers may be formed from a variety of materials such as glass or plastic and may have a sterile access port (for example, the container may be an intravenous solution bag or a vial having a stopper pierceable by a hypodermic injection needle). The kit may further comprise more containers comprising a pharmaceutically acceptable buffer, such as phosphate-buffered saline, Ringer's solution and dextrose solution. It may further include other materials desirable from a commercial and user standpoint, including other buffers, diluents, filters, needles, syringes, culture medium for one or more of the suitable hosts. Associated with the kits can be instructions customarily included in commercial packages of therapeutic, prophylactic or diagnostic products, that contain information about, for example, the indications, usage, dosage, manufacture, administration, contraindications and/or warnings concerning the use of such therapeutic, prophylactic or diagnostic products.

The invention further pertains to a method of detecting a SARS-CoV in a sample, wherein the method comprises the steps of a) contacting a sample with a diagnostically effective amount of a binding molecule, a functional variant or an immunoconjugate according to the invention, and b) determining whether the binding molecule, functional variant, or immunoconjugate specifically binds to a molecule of the sample. The sample may be a biological sample including, but not limited to blood, serum, urine, tissue or other biological material from (potentially) infected subjects, or a nonbiological sample such as water, drink, etc. The (potentially) infected subjects may be human subjects, but also animals that are suspected as carriers of SARS-CoV might be tested for the presence of SARS-CoV using the binding molecules, functional variants or immunoconjugates of the invention. The sample may first be manipulated to make it more suitable for the method of detection. Manipulation mean inter alia treating the sample suspected to contain and/or comprising SARS-CoV in such a way that the SARS-CoV will disintegrate into antigenic components such as proteins, (poly)peptides or other antigenic fragments. Preferably, the binding molecules, functional variants or immunoconjugates of the invention are contacted with the sample under conditions which allow the formation of an immunological complex between the binding molecules and SARS-CoV or antigenic components thereof that may be present in the sample. The formation of an immunological complex, if any, indicating the presence of SARS-CoV in the sample, is then detected and measured by suitable means. Such methods include, inter alia, homogeneous and heterogeneous binding immunoassays, such as radioimmunoassays (RIA), ELISA, immunofluorescence, immunohistochemistry, FACS, BIACORE and Western blot analyses.

Preferred assay techniques, especially for large-scale clinical screening of patient sera and blood and blood-derived products are ELISA and Western blot techniques. ELISA tests are particularly preferred. For use as reagents in these assays, the binding molecules, functional variants or immunoconjugates of the invention are conveniently bonded to the inside surface of microtiter wells. The binding molecules, functional variants or immunoconjugates of the invention may be directly bonded to the microtiter well. However, maximum binding of the binding molecules, functional variants or immunoconjugates of the invention to the wells might be accomplished by pretreating the wells with polylysine prior to the addition of the binding molecules, functional variants or immunoconjugates of the invention. Furthermore, the novel the binding molecules, functional variants or immunoconjugates of the invention may be covalently attached by known means to the wells. Generally, the binding molecules, functional variants or immunoconjugates of the invention are used in a concentration of between 0.01 to 100 µg/ml for coating, although higher as well as lower amounts may also be used. Samples are then added to the wells coated with the binding molecules, functional variants or immunoconjugates of the invention.

Furthermore, the binding molecules or functional variants of the invention can be used to identify epitopes of SARS-CoV. The epitopes can be linear, but also structural and/or conformational. In one embodiment, binding of binding molecules or functional variants of the invention to a series of overlapping peptides, such as 15-mer peptides, of a protein from SARS-CoV can be analyzed by means of PEPSCAN analysis (see inter alia WO 84/03564, WO 93/09872, Slootstra et al. 1996). The binding of binding molecules to each peptide can be tested in a PEPSCAN-based enzyme-linked immuno assay (ELISA). In another embodiment, a random peptide library comprising peptides from SARS-CoV can be screened for peptides capable of binding to the binding molecules or functional variants of the invention. In the above assays the use of neutralizing binding molecules may identify one or more neutralizing epitopes. The peptides/epitopes found can be used as vaccines and for the diagnosis of SARS. In yet a further embodiment, the binding of (neutralizing) binding molecules of the invention to domains of a surface protein of SARS-CoV, such as the spike glycoprotein, may be analyzed. Alternatively, the binding molecules of the invention may identify one or more epitopes of another protein of SARS-CoV including, but not limited to, the membrane protein (M protein), the small envelope protein (E protein) and the nucleocapsid protein (N protein). In a preferred embodiment binding molecule 018 recognized epitopes on the N protein. These epitopes might be useful in the treatment but also in the detection of SARS-CoV.

In a further aspect, the invention provides a method of screening a binding molecule or a functional variant of a binding molecule for specific binding to the same epitope of a SARS-CoV as the epitope bound by a binding molecule or functional variant of the invention, wherein the method comprises the steps of a) contacting a binding molecule or a functional variant to be screened, a binding molecule or functional variant of the invention and a SARS-CoV or fragment thereof, b) measure if the binding molecule or functional variant to be screened is capable of competing for specifically binding to the SARS-CoV or fragment thereof with the binding molecule or functional variant of the invention. In a further step it may be determined if the screened binding molecules that are capable of competing for specifically binding to the SARS-CoV or fragment thereof have neutralizing activity. A binding molecule or functional variant that is capable of competing for specifically binding to the SARS-CoV or fragment thereof with the binding molecule or functional variant of the invention is another part of the present invention. In the above-described screening method, "specifically binding to the same epitope" also contemplates specific binding to substantially or essentially the same epitope as the epitope bound by the binding molecules of the invention. The capacity to block, or compete with, the binding of the binding molecules of the invention to SARS-CoV typically indicates that a binding molecule to be screened binds to an epitope or binding site on SARS-CoV that structurally overlaps with the binding site on SARS-CoV that is immunospecifically recognized by the binding molecules of the invention. Alternatively, this can indicate that a binding molecule to be screened binds to an epitope or binding site which is sufficiently proximal to the binding site immunospecifically recognized by the binding molecules of the invention to sterically or otherwise inhibit binding of the binding molecules of the invention to SARS-CoV.

In general, competitive inhibition is measured by means of an assay, wherein an antigen composition, i.e., a composition comprising SARS-CoV or fragments thereof, is admixed with reference binding molecules, i.e., the binding molecules of the invention, and binding molecules to be screened. Usually, the binding molecules to be screened are present in excess. Protocols based upon ELISAs and Western blotting are suitable for use in such simple competition studies. In certain embodiments, one may pre-mix the reference binding molecules with varying amounts of the binding molecules to be screened (e.g., 1:10, 1:20, 1:30, 1:40, 1:50, 1:60, 1:70, 1:80, 1:90 or 1:100) for a period of time prior to applying to the antigen composition. In other embodiments, the reference binding molecules and varying amounts of binding molecules to be screened can simply be admixed during exposure to the antigen composition. In any event, by using species or isotype secondary antibodies one will be able to detect only the bound reference binding molecules, the binding of which will be reduced by the presence of a binding molecule to be screened that recognizes substantially the same epitope. In conducting a binding molecule competition study between a reference binding molecule and any binding molecule to be screened (irrespective of species or isotype), one may first label the reference binding molecule with a detectable label, such as, e.g., biotin, an enzymatic, a radioactive or other label to enable subsequent identification. In these cases, one would pre-mix or incubate the labeled reference binding molecules with the binding molecules to be screened at various ratios (e.g., 1:10, 1:20, 1:30, 1:40, 1:50, 1:60, 1:70, 1:80, 1:90 or 1:100) and (optionally after a suitable period of time) then assay the reactivity of the labeled reference binding molecules and compare this with a control value in which no potentially competing binding molecule was included in the incubation. The assay may again be any one of a range of immunological assays based upon antibody hybridization, and the reference binding molecules would be detected by means of detecting their label, e.g., using streptavidin in the case of biotinylated reference binding molecules or by using a chromogenic substrate in connection with an enzymatic label (such as 3,3'5,5'-tetramethylbenzidine (TMB) substrate with peroxidase enzyme) or by simply detecting a radioactive label. A binding molecule to be screened that binds to the same epitope as the reference binding molecule will be able to effectively compete for binding and thus will significantly reduce reference binding molecule binding, as evidenced by a reduction in bound label. The reactivity of the (labeled) reference binding molecule in the absence of a completely irrelevant binding molecule would be the control high value. The control low value would be obtained by incubating the labeled reference binding molecule with unlabelled reference binding molecules of exactly the same type, when competition would occur and reduce binding of the labeled reference binding molecule. In a test assay, a significant reduction in labeled reference binding molecule reactivity in the presence of a binding molecule to be screened is indicative of a binding molecule that recognizes the same epitope, i.e., one that "cross-reacts" with the labeled reference binding molecule.

Binding molecules identified by these competition assays ("competitive binding molecules" or "cross-reactive binding molecules") include, but are not limited to, antibodies, antibody fragments and other binding agents that bind to an epitope or binding site bound by the reference binding molecule, i.e., a binding molecule of the invention, as well as antibodies, antibody fragments and other binding agents that bind to an epitope or binding site sufficiently proximal to an epitope bound by the reference binding molecule for competitive binding between the binding molecules to be screened and the reference binding molecule to occur. Preferably, competitive binding molecules of the invention will, when present in excess, inhibit specific binding of a reference binding molecule to a selected target species by at least 10%, preferably by at least 25%, more preferably by at least 50%, and most preferably by at least 75%-90% or even greater. The identification of one or more competitive binding molecules that bind to about, substantially, essentially or at the same epitope as the binding molecules of the invention is a straightforward technical matter. As the identification of competitive binding molecules is determined in comparison to a reference binding molecule, i.e., a binding molecule of the invention, it will be understood that actually determining the epitope to which the reference binding molecule and the competitive binding molecule bind is not in any way required in order to identify a competitive binding molecule that binds to the same or substantially the same epitope as the reference binding molecule.

In yet a further aspect, the invention relates to a method of identifying a binding molecule, preferably a human binding molecule, potentially having neutralizing activity against SARS-CoV, wherein the method comprises the steps of (a) contacting a collection of binding molecules on the surface of replicable genetic packages with the SARS-CoV under conditions conducive to binding, (b) separating and recovering binding molecules that bind to the SARS-CoV from binding molecules that do not bind, (c) isolating at least one recovered binding molecule, (d) verifying if the binding molecule isolated has neutralizing activity against the SARS-CoV, characterized in that the SARS-CoV in step a is inactivated. The inactivated SARS-CoV may be purified before being inactivated. Purification may be performed by means of well known purification methods suitable for viruses such as for instance centrifugation through a glycerol cushion. The inactivated SARS-CoV in step (a) may be immobilized to a suitable material before use.

A replicable genetic package as used herein can be prokaryotic or eukaryotic and includes cells, spores, bacteria, viruses, (bacterio)phage and polysomes. A preferred replicable genetic package is a phage. The binding molecules, such as for instance single chain Fvs, are displayed on the replicable genetic package, i.e., they are attached to a group or molecule located at an exterior surface of the replicable genetic package. The replicable genetic package is a screenable unit comprising a binding molecule to be screened linked to a nucleic acid molecule encoding the binding molecule. The nucleic acid molecule should be replicable either in vivo (e.g., as a vector) or in vitro (e.g., by PCR, transcription and translation). In vivo replication can be autonomous (as for a cell), with the assistance of host factors (as for a virus) or with the assistance of both host and helper virus (as for a phagemid). Replicable genetic packages displaying a collection of binding molecules is formed by introducing nucleic acid molecules encoding exogenous binding molecules to be displayed into the genomes of the replicable genetic packages to form fusion proteins with endogenous proteins that are normally expressed from the outer surface of the replicable genetic packages. Expression of the fusion proteins, transport to the outer surface and assembly results in display of exogenous binding molecules from the outer surface of the replicable genetic packages.

The inactivation of the SARS-CoV may be performed by viral inactivation methods well known to the skilled artisan such as inter alia pasteurization (wet heat), i.e., heat treatment while still in aqueous solution, at 60° C. for ten hours; dry heat treatment, i.e., heat treatment in the lyophilized state, at 80° C. for 72 hours; vapor heat treatment at 60° C. for ten hours and then 80° C. for one hour; treatment with low pH, i.e., pH 4 for six hours to 21 days; treatment with organic solvent/detergent, i.e., addition of organic solvents and detergents (Triton X-100 or Tween-80) to the virus; treatment by means of cold ethanol fractionation; column chromatography; nanofiltration; UV/light irradiation; gamma-irradiation; and addition of iodine. Preferably, the inactivation is performed by gamma- or UV-irradiation. Methods to test if a virus is still infective or partly or completely inactivated are well known to the person skilled in the art.

In a further aspect, the invention pertains to a binding molecule having neutralizing activity against the SARS-CoV and being obtainable by the identification method as described above. A pharmaceutical composition comprising the binding molecule, the pharmaceutical composition further comprising at least one pharmaceutically acceptable excipient is also an aspect of the present invention. Pharmaceutically acceptable excipients are described above. The pharmaceutical composition according to the invention may further comprise at least one other therapeutic agent. Suitable agents have been described above.

The invention further relates to the binding molecule or a pharmaceutical composition according to the invention for use as a medicament. They can be used in the diagnosis, prophylaxis, treatment, or combination thereof of a condition resulting from SARS-CoV.

EXAMPLES

To illustrate the invention, the following examples are provided. The examples are not intended to limit the scope of the invention in any way.

Example 1

Selection of Phage Carrying Single-Chain Fv Fragments Specifically Recognizing SARS-CoV Antibody fragments were selected using antibody phage display libraries and technology, essentially as described in U.S. Pat. No. 6,265,150 and in WO 98/15833, both of which are incorporated herein in their entirety. All procedures were performed at room temperature unless stated otherwise. An inactivated SARS-CoV preparation (Frankfurt 1 strain) was prepared as follows. Medium from Vero cells which were infected with SARS-CoV strain Frankfurt 1 was harvested as soon as cyotopathic effect (CPE) was observed. Cell debris was removed by centrifugation of the harvested medium for 15 minutes at 3000 rpm. The obtained supernatant was collected, spun again for 15 minutes at 3000 rpm and transferred to a clean tube. Subsequently, ultracentrifuge tubes were filled with 10 ml sterile 25% glycerol in PBS. Twenty ml of the cleared supernatant was gently applied on the glycerol cushion and the tubes were spun for two hours at 20,000 rpm at 4° C. The supernatant was discarded and the virus pellets were resuspended in 1 ml TNE buffer (10 mM Tris-HCl pH 7.4, 1 mM EDTA, 200 mM NaCl) and stored at −80° C. Next, the resuspended virus pellets were gamma-irradiated at 45 kGy on dry ice. Subsequently, they were tested for the absence of infectivity in cell culture. If absence of infectivity was established, the thus obtained inactivated SARS-CoV preparation was used for selection of single-chain phage antibodies specifically binding to SARS-CoV.

The inactivated virus preparation and heat-inactivated fetal bovine serum (FBS) were coated overnight at 4° C. onto the surface of separate MAXISORP™ plastic tubes (Nunc). The tubes were blocked for two hours in 3 ml PBS containing 2% FBS and 2% fat free milk powder (2% PBS-FM). After two hours, the FBS-coated tube was emptied and washed three times with PBS. To this tube, 500 μl (approximately $10^{13}$ cfu) of a phage display library expressing single-chain Fv fragments (scFvs) essentially prepared as described by De Kruif et al. (1995a) and references therein (which are incorporated herein in their entirety), 500 μl 4% PBS-FM and 2 ml 2% PBS-FM were added. The tube was sealed and rotated slowly at room temperature for two hours. Subsequently, the obtained blocked phage library (3 ml) was transferred to a SARS-CoV preparation-coated tube that had been washed three times with PBS. Tween-20 was added to a final concentration of 0.05% and binding was allowed to proceed for two hours on a slowly rotating wheel at room temperature or at 37° C. The tube was emptied and washed ten times with PBS containing 0.05% Tween-20, followed by washing ten times with PBS. One ml glycine-HCL (0.05 M, pH 2.2) was added to elute bound phages, and the tube was rotated slowly for ten minutes. For neutralization purposes, the eluted phages were added to 500 μl 1 M Tris-HCl pH 7.4. To this mixture, 5 ml of exponentially growing XL-1 blue bacterial culture was added. The obtained culture was incubated for thirty minutes at 37° C. without shaking. Then, the bacteria were plated on TYE agar plates containing ampicillin, tetracycline and glucose. After overnight incubation of the plates at 37° C., the colonies were scraped from the plates and used to prepare an enriched phage library, essentially as described by De Kruif et al. (1995a) and WO 02/103012 (both are incorporated by reference herein). Briefly, scraped bacteria were used to inoculate 2TY medium containing ampicillin, tetracycline and glucose and grown at a temperature of 37° C. to an OD 600 nm of ~0.3. CT or VCSM13 helper phages were added and allowed to infect the bacteria after which the medium was changed to 2TY containing ampicillin, tetracycline and kanamycin. Incubation was continued overnight at 30° C. The next day, the bacteria were removed from the 2TY medium by centrifugation after which the phages in the obtained supernatant were precipitated using polyethylene glycol 6000/NaCl. Finally, the phages were dissolved in a small volume of PBS containing 1% BSA, filter-sterilized and used for a next round of selection. The selection/re-infection procedure was performed two or three times. After each round of selection, individual *E. coli* colonies were used to prepare monoclonal phage antibodies. Essentially, individual colonies were grown to log-phase and infected with VCSM13 helper phages after which phage antibody production was allowed to proceed overnight. Phage antibody containing supernatants were tested in ELISA for binding activity to the SARS-CoV preparation which was coated to 96-well plates. In the above-described selection, the phage antibodies called SC03-001, SC03-002, SC03-003, SC03-004, SC03-005, SC03-006, SC03-007, SC03-008, SC03-009, SC03-0010, SC03-012, SC03-013, SC03-014 and SC03-015 were obtained.

To overcome selection of previously identified phage antibodies, alternative selections in the presence of scFvs corresponding to the previous selected phage antibodies were performed as follows. ScFvs of the phage antibodies SC03-001, SC03-002, SC03-003, SC03-004, SC03-005, SC03-006, SC03-007, SC03-008, SC03-009, SC03-0010, SC03-012, SC03-013, SC03-014 and SC03-015 were produced as described before in De Kruif et al. (1995b). The buffer of the scFvs was adjusted to 1×PBS. Then the scFvs were mixed with 500 μl (approximately $10^{13}$ cfu) of a phage display library expressing single-chain Fv fragments essentially prepared as described by De Kruif et al. (1995a) and references therein (which are incorporated herein in their entirety). Next, the obtained mixture was blocked in an FBS-coated tube as described above and subsequently selection was carried out with the obtained blocked mixture essentially as described above for the blocked phage library. In this alternative selection, the phage antibodies called SC03-016, SC03-017 and SC03-018 were obtained.

Example 2

Validation of the SARS-CoV Specific Single-Chain Phage Antibodies

Selected single-chain phage antibodies that were obtained in the screens described above, were validated in ELISA for specificity, i.e., binding to the SARS-CoV preparation prepared as described supra. Additionally, the single-chain phage antibodies were also tested for binding to 10% FBS. For this purpose, the SARS-CoV preparation or 10% FBS preparation was coated to MAXISORP™ ELISA plates. After coating, the plates were blocked in 2% PBS-FM. The selected single-chain phage antibodies were incubated in an equal volume of 4% PBS-FM to obtain blocked phage antibodies. The plates were emptied, washed three times with PBS, after which the blocked phage antibodies were added. Incubation was allowed to proceed for one hour, the plates were washed in PBS containing 0.05% Tween-20 and bound phage antibodies were detected (using OD 492 nm measurement) using an anti-M13 antibody conjugated to peroxidase. As a control, the procedure was performed simultaneously using no single-chain phage antibody or control single-chain phage antibody directed against thyroglobulin (SC02-006) (see De Kruif et al. 1995a and 1995b) or control single-chain phage antibody directed against CD46 (SC02-300). Both controls served as a negative control. As shown in Table 1 and FIG. 1, the selected phage antibodies called SC03-001, SC03-002, SC03-003, SC03-005, SC03-006, SC03-007, SC03-008, SC03-009, SC03-0010, SC03-012, SC03-013, SC03-014 and SC03-015 displayed significant binding to the immobilized SARS-CoV preparation, while no binding to FBS was observed.

As shown in Table 2 and FIG. 2, the selected phage antibody called SC03-018 displayed significant binding to the immobilized SARS-CoV preparation, while no binding to FBS was observed. The selected phage antibody called SC03-016 and SC03-017 displayed binding to the immobilized SARS-CoV preparation compared to binding to FBS, although in a lesser amount than SC03-018.

Example 3

Characterization of the scFvs Specific for SARS-CoV

From the selected specific single chain phage antibody (scFv) clones plasmid DNA was obtained and nucleotide sequences were determined according to standard techniques. The nucleotide sequences of the scFvs (including restriction sites for cloning) called SC03-001, SC03-002, SC03-003, SC03-004, SC03-005, SC03-006, SC03-007, SC03-008, SC03-009, SC03-0010, SC03-012, SC03-013, SC03-014 and SC03-015 are shown in SEQ ID NO:46, SEQ ID NO:48, SEQ ID NO:50, SEQ ID NO:89, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68 and SEQ ID NO:70, respectively. The amino acid sequences of the scFvs called SC03-001, SC03-002, SC03-003, SC03-004, SC03-005, SC03-006, SC03-007, SC03-008, SC03-009, SC03-0010, SC03-012, SC03-013, SC03-014 and SC03-015 are shown in SEQ ID NO:47, SEQ ID NO:49, SEQ ID NO:51, SEQ ID NO:90, SEQ ID NO:53, SEQ ID NO:55, SEQ ID NO:57, SEQ ID NO:59, SEQ ID NO:61, SEQ ID NO:63, SEQ ID NO:65, SEQ ID NO:67, SEQ ID NO:69 and SEQ ID NO:71, respectively. Furthermore, the nucleotide sequences of the scFvs (including restriction sites for cloning) called SC03-016, SC03-017 and SC03-018 are shown in SEQ ID NO:91, SEQ ID NO:93 and SEQ ID NO:95, respectively. The amino acid sequences of the scFvs called SC03-016, SC03-017 and SC03-018 are shown in SEQ ID NO:92, SEQ ID NO:94 and SEQ ID NO:96, respectively.

The VH and VL gene identity (see I. M. Tomlinson, S. C. Williams, O. Ignatovitch, S. J. Corbett., G. Winter, V-BASE Sequence Directory, Cambridge United Kingdom: MRC Centre for Protein Engineering (1997)) and heavy chain CDR3 compositions of the scFvs specifically binding the SARS-CoV preparation are depicted in Table 3.

Example 4

Production of Human SARS-CoV Specific Bivalent scFvs in *Pichia Pastoris*

Figure 3A:
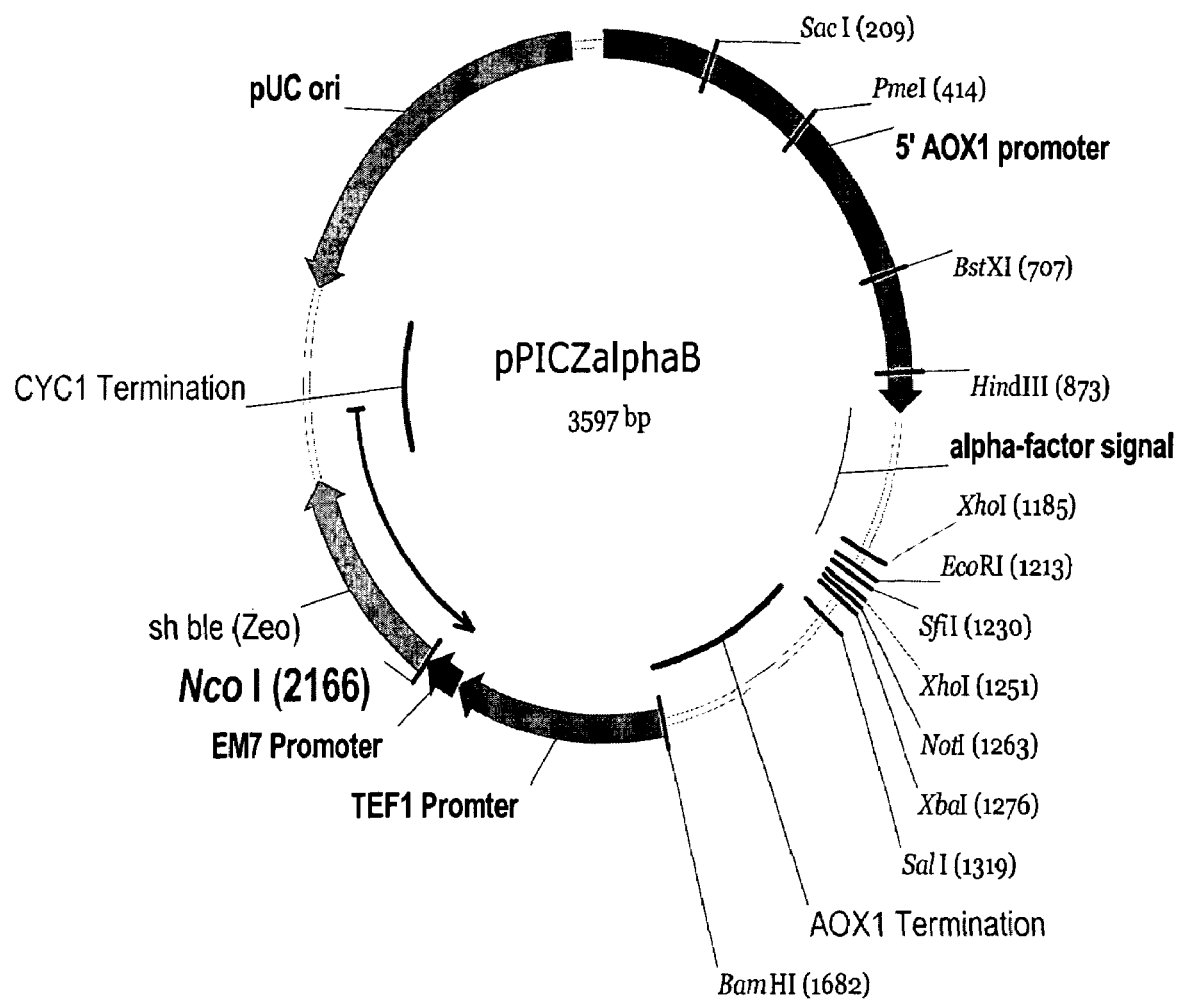
In FIG. 3A the vector pPICZαB is shown and in FIG. 3B the bivalent scFv expression vector pPicZbiFVH is shown.
Figure 3B:
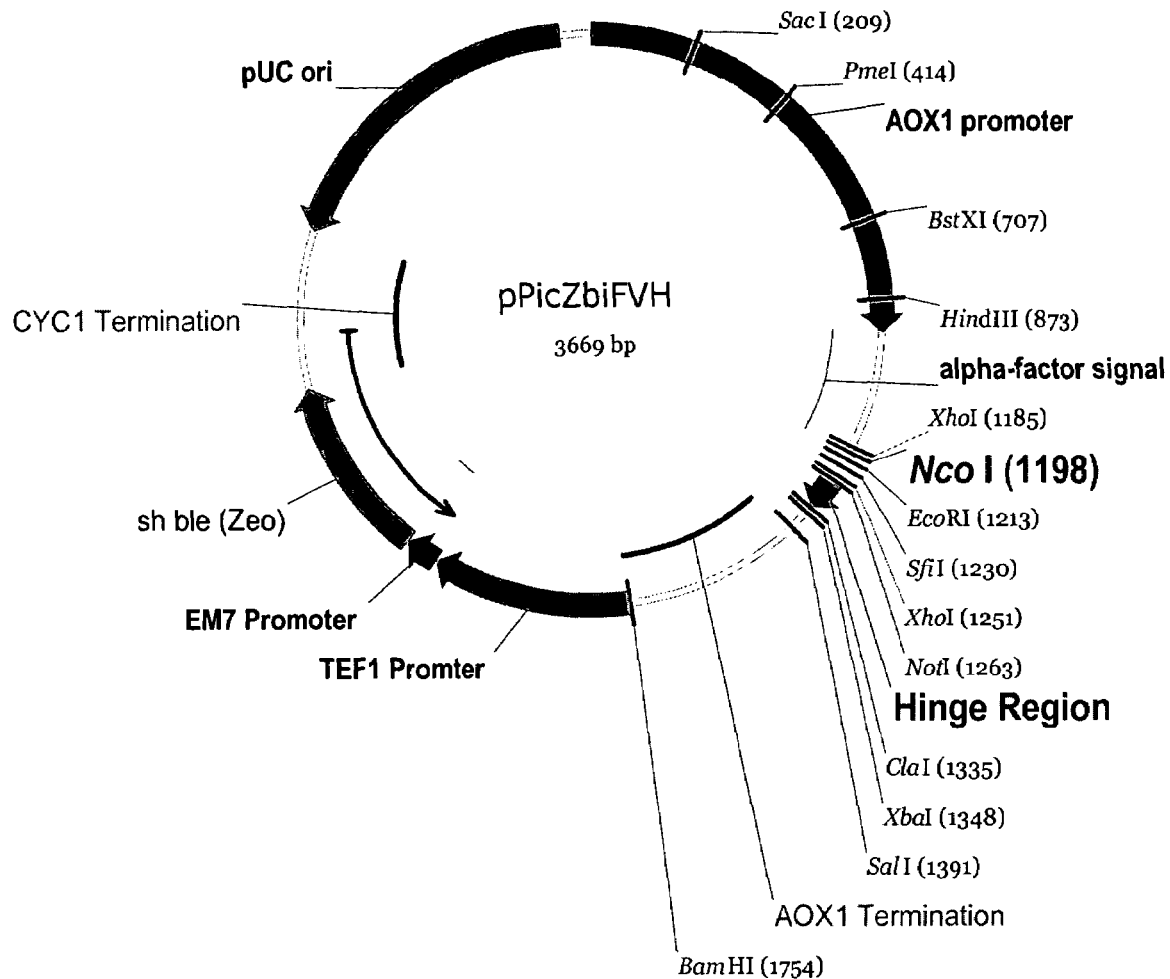
FIG. 3 shows the construction of the bivalent scFv expression vector pPICZbiFVH.
FIG. 3C shows the cloning strategy of scFvs into pPicZbiFVH.

Methods for the cloning and expression of bivalent scFv fragments in the *Pichia pastoris* system were based on protocols provided by the supplier (Invitrogen) in "A Manual of Methods for Expression of Recombinant Proteins Using pPICZ and pPICZα in *Pichia pastoris* (Version F)." The bivalent scFv expression vector pPicZbiFVH (see FIG. 3B) was constructed from the vector pPICZαB (see FIG. 3A) (Invitrogen) following standard molecular biology techniques known to a person skilled in the art. Three modifications were introduced in the pPICZαB (see FIG. 3C):

1. A restriction site (NcoI) was introduced by PCR-generated point mutation directly after the KEK2 cleavage site of the signal peptide to facilitate cloning into the vector.

2. A second NcoI restriction site was removed by PCR generated point mutation inside the coding region of the sh ble gene.

3. A synthetic fragment comprising the hinge region of murine IgG3 and a linker fragment was introduced between the restriction sites NotI and XbaI.

All modifications were confirmed by sequencing. ScFvs were cloned into pPicZbiFVH from the phage display expression vector by directional cloning using the restriction sites NcoI and NotI. The *Pichia pastoris* strain SMD1168 kek1: suc1 (ATCC # 204414) was transformed with 5-10 µg of linearized construct cDNA by electroporation according to the manufacturer's protocols (supra). The transformed cells were plated on YPDS agar containing 250 µg/ml Zeocin and incubated at 30° C. for three to four days. High producing clones were selected by colony lift immunoblot screening, as follows. Pre-wet nitrocellulose membranes were layered over the transformation plates and a fraction of each colony was lifted onto the membrane. The membrane was then placed colony side up on YPD agar containing 0.5% methanol and incubated overnight at 30° C. The membranes were then washed repeatedly with Tris buffered saline containing 0.5% Tween-20 (TBST) to remove colonies, then blocked for 30 minutes with TBST and 4% non-fat milk powder. The membranes were then placed in TBST containing 4% non-fat milk powder and horseradish peroxidase conjugated anti-c-myc antibody (Roche) for one hour. Finally, the membranes were washed extensively in TBST followed by a PBS washing step and scFv-secreting colonies were revealed by a chemofluorescence detection system (Apbiochem). Selected high producers were purified by streaking on YPD plates and were subsequently used for bivalent scFv expression. Small-scale expression cultures were carried out in shaker flasks essentially as described by the manufacturer's protocols (supra). BMGY medium was used for the cell expansion phase, while BMMY medium was used during the bivalent scFv expression phase. After 48 hours of induction, supernatants were clarified by repeated centrifugation. The supernatant was conditioned for purification by the addition of 1 M $Na_2HPO_4$ pH 8 to a concentration of 20 mM, 0.5 M Imidazole to a concentration of 10 mM, 5 M NaCl to a concentration of 500 mM. Hereafter, the samples were purified by immobilized metal affinity chromatography followed by anion exchange chromatography on an AKTAprime FPLC-system (Pharmacia). A 5 ml HiTrap chelating column (Pharmacia) was charged with $NiSO_4$ and equilibrated according to the manufacturer's instructions. Conditioned supernatant was loaded directly onto the column and washed extensively in equilibration buffer (20 mM $Na_2PO_4$ pH 8, 10 mM imidazole). Bivalent scFv were eluted directly off the column on to a 1 ml sepharose Q HP column (Pharmacia) in the presence of 250 mM imidazole pH 8.5. The column was then washed in 20 mM Tris-HCl pH 8, then briefly in 20 mM $Na_2PO_4$ pH 7.3, and bivalent scFvs were eluted off the column over a gradient of 0-0.5 M NaCl in 7 column volumes. Fractions were then measured for protein content and were analyzed for activity and purity. The bivalent scFvs of the selected scFvs called SC03-001, SC03-002, SC03-003, SC03-005, SC03-006, SC03-007, SC03-008, SC03-009, SC03-0010, SC03-012, SC03-013, SC03-014 and SC03-015 were called pyBi03-001C02, pyBi03-002C02, pyBi03-003C02, pyBi03-005C02, pyBi03-006C02, pyBi03-007C02, pyBi03-008C02, pyBi03-009C02, pyBi03-010C02, pyBi03-012C02, pyBi03-013C02, pyBi03-014C02, pyBi03-015C02, respectively.

Example 5

Construction of Fully Human Immunoglobulin Molecules (Human Monoclonal Anti-SARS-CoV Antibodies) from the Selected Anti-SARS-CoV Single Chain Fvs Heavy and light chain variable regions of the scFvs called SC03-001, SC03-002, SC03-009, SC03-013, SC03-014 and SC03-018 were PCR-amplified using oligonucleotides to append restriction sites and/or sequences for expression in the IgG expression vectors pSyn-C03—HCγ1 (see SEQ ID NO:110) and pSyn-C05-Cκ (see SEQ ID NO:111), respectively. The $V_L$ gene shared between scFvs was amplified using oligonucleotides 5K-I (SEQ ID NO:112) and sy3K-C (SEQ ID NO:113) (see below) and the PCR products cloned into vector pSyn-C05—Cκ. Nucleotide sequences for all constructs were verified according to standard techniques known to the skilled artisan. $V_H$ genes were amplified using the following oligonucleotide set: 5H-B (SEQ ID NO:114) and sy3H-A (SEQ ID NO:115). Thereafter, the PCR products were cloned into vector pSyn-C03-HCγ1 and nucleotide sequences were verified according to standard techniques known to the skilled person in the art.

```
5H-B     acctgtcttgaattctccatggccgaggtgcagct
         ggtggagtctg sy3H-A   gcccttggtgctagcgctggagacggtcaccaggg
         tgccctggcccc 5K-I     acctgtctcgagttttccatggctgacatccagat
         gacccagtctccatcctcc sy3K-C   gggaccaaggtggagatcaaacggaccgtggccgc
         ccccagc
```

The resulting expression constructs pgG103-001C03, pgG103-002C03, pgG103-009C03, pgG103-013C03, pgG103-014C03 and pgG103-018C03 encoding the anti-SARS-CoV human IgG1 heavy chains were transiently expressed in combination with the pSyn-C05-VkI construct encoding the common light chain in 293T cells and supernatants containing IgG1 antibodies were obtained. The nucleotide sequences of the heavy chains of the antibodies called 03-001, 03-002, 03-009, 03-013, 03-014 and 03-018 are shown in SEQ ID NOS:116, 118, 120, 122, 124 and 126, respectively. The amino acid sequences of the heavy chains of the antibodies called 03-001, 03-002, 03-009, 03-013, 03-014 and 03-018 are shown in SEQ ID NOS:117, 119, 121, 123, 125 and 127, respectively.

The nucleotide sequences of the light chain of antibodies 003-001, 03-002, 03-009, 03-013, 03-014 and 03-018 is shown in SEQ ID NO:128. The amino acid sequences of the light chain of antibodies 03-001, 03-002, 03-009, 03-013, 03-014 and 03-018 is shown in SEQ ID NO:129. Essentially as described above the antibodies called 03-006 and 03-015 were generated. The nucleotide sequences of the heavy chains of the antibodies called 03-006 and 03-015 are shown in SEQ ID NO:471 and SEQ ID NO:473, respectively. The amino acid sequences of the heavy chains of the antibodies called 03-006 and 03-015 are shown in SEQ ID NO:472 and SEQ ID NO:474, respectively. The nucleotide sequences of the light chain of antibodies called 03-006 and 03-015 are shown in SEQ ID NO:475 and SEQ ID NO:477, respectively. The amino acid sequences of the light chain of antibodies called 03-006 and 03-015 are shown in SEQ ID NO:476 and SEQ ID NO:478, respectively. Subsequently, the recombinant human monoclonal antibodies were purified over protein-A columns and size-exclusion columns using standard purification methods used generally for immunoglobulins (see for instance WO 00/63403 which is incorporated by reference herein).

Example 6

Figure 4:
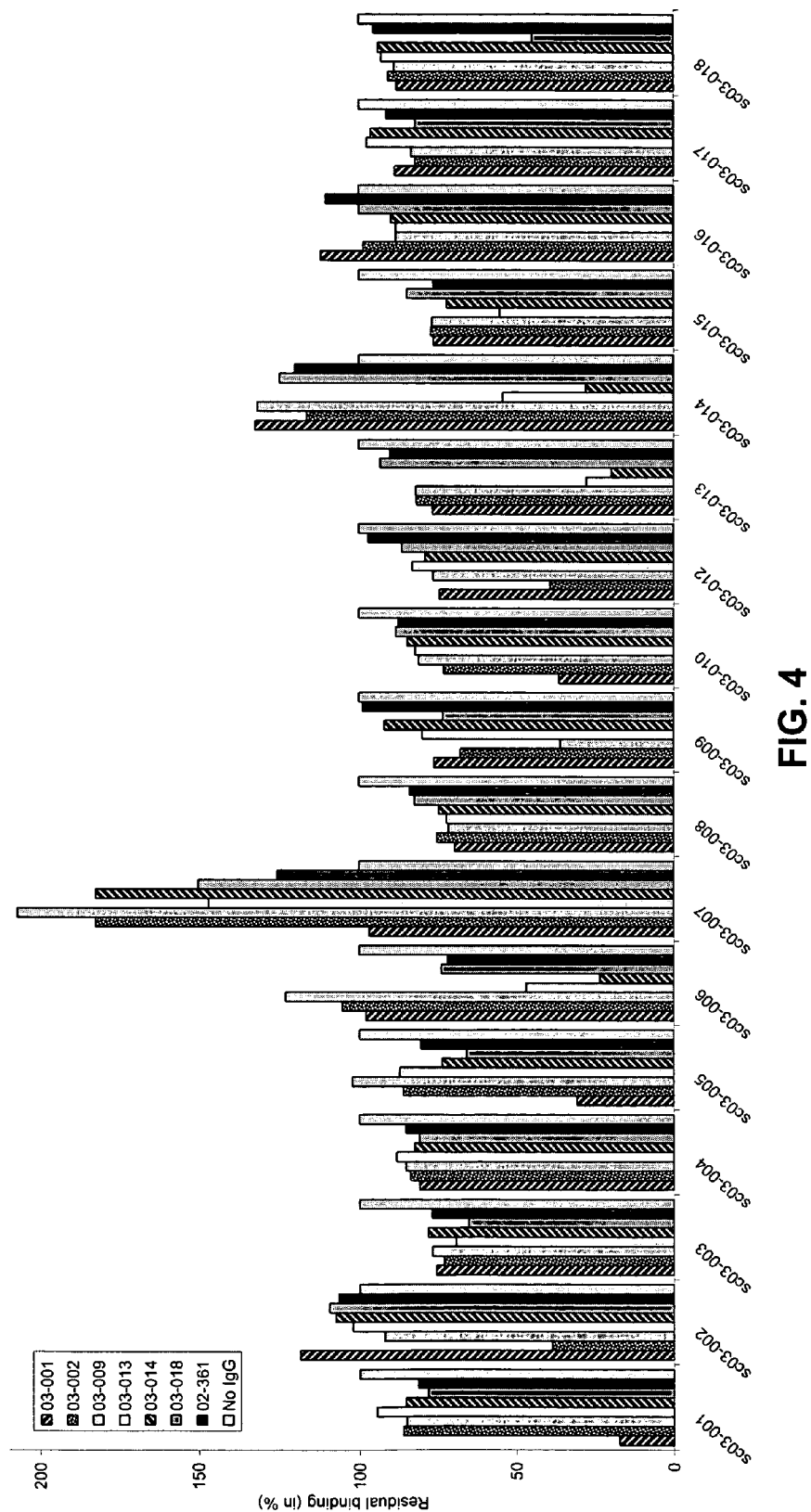
FIG. 4 shows a competition ELISA of the SARS-CoV specific single-chain phage antibodies called SC03-001, SC03-002, SC03-003, SC03-004, SC03-005, SC03-006, SC03-007, SC03-008, SC03-009, SC03-010, SC03-012, SC03-013, SC03-014, SC03-015, SC03-016, SC03-017 and SC03-018 and the human monoclonal anti-SARS-CoV antibodies called (from left to right for each single chain antibody) 03-001, 03-002, 03-009, 03-013, 03-014 and 03-018. The antibody called 02-361 is a control antibody (second column from the right side). On the X-axis the single-chain phage antibodies that were tested are shown and on the Y-axis the residual binding (in %) of the single-chain phage antibodies to the SARS-CoV preparation in the presence of human monoclonal anti-SARS-CoV antibodies is shown. The binding value in the absence of human monoclonal anti-SARS-CoV antibody is set at 100%. This value can be found at the right side of each single-chain phage antibody (no IgG).

Competition ELISA of Human Monoclonal Anti-SARS-CoV Antibodies and Single Chain Phage Antibodies Specific for SARS-CoV To determine whether the above selected single-chain phage antibodies bind to similar or overlapping epitopes which are recognized by the recombinant human monoclonal anti-SARS-CoV antibodies of the invention a competition ELISA was performed. Briefly, a gamma-irradiated SARS-CoV preparation was immobilized as described supra. The immobilized SARS-CoV preparation and the selected single-chain phage antibodies were blocked in an equal volume of 4% ELK in PBS. Subsequently, the blocked immobilized SARS-CoV preparation was incubated with a blocked single-chain phage antibody in the presence or absence of 1 μg/ml of an anti-SARS-CoV IgG for one hour at room temperature. Binding of the single-chain phage antibody was monitored as described supra. A reduction of binding of the single-chain phage antibody to the SARS-CoV preparation in the presence of anti-SARS-CoV IgG compared to binding of single-chain phage antibody alone indicated that similar or overlapping epitopes were recognized by the single-chain phage antibody and the anti-SARS-CoV IgG. As shown in FIG. 4, the anti-SARS-CoV IgG called 03-001 was capable of significantly reduce binding of the single-chain phage antibodies SC03-001, SC03-005, and SC03-0010. The anti-SARS-CoV IgG called 03-002 reduced binding of both SC03-002 and SC03-012, whereas the anti-SARS-CoV IgGs called 03-009 and 03-018 reduced binding of the single-chain phage antibodies called SC03-009 and SC03-018, respectively. The anti-SARS-CoV IgGs called 03-013 and 03-014 reduced binding of SC03-013, SC03-014 and SC03-006. In addition, IgG pGg03-013 slightly reduced binding of SC03-015.

Example 7

Screening Assay for SARS-CoV Neutralizing Activity of Recombinant Human Anti-SARS-CoV Bivalent scFvs and Recombinant Human Anti-SARS-CoV Antibodies The SARS-CoV neutralization assay was performed on Vero cells (ATCC CCL 81). The SARS-CoV strains used in the neutralization assay were the Frankfurt 1 strain (for the complete genome of this strain see EMBL-database accession # AY291315) and the Frankfurt 2 strain, derived from a patient who acquired the infection from the Frankfurt 1—index case (Rickerts et al. 2003). This latter SARS-isolate has not yet been sequenced. Virus stocks of the strains were used in a titer of 4× $10^3$ $TCID_{50}$/ml (50% tissue culture infective dose per ml), with the titer calculated according to the well known method of Spearman and Kaerber. Recombinant human anti-SARS-CoV bivalent scFvs and recombinant human anti-SARS-CoV antibodies produced as described above were prescreened by serially two-fold dilution of the undiluted material in PBS starting from 1:10 (dilution range 1:10-1:320). A neutralization titer of ≧1:10 was regarded as specific evidence of reactivity of the bivalent scFvs or the antibodies against SARS-CoV in the prescreening assay. To determine the antibody-concentration-dependent neutralizing activity the bivalent scFvs or the antibodies against SARS-CoV were then adjusted to a protein concentration of 10 μg/ml and serially two-fold diluted in PBS (dilution range 1:2 to 1:512). In general, the neutralization assay worked as follows. 25 μl of the respective bivalent scFv or antibody dilutions were mixed with 25 μl of virus suspension (=approx. 100 $TCID_{50}$/25 μl) and incubated for one hour at 37° C. The suspension was then pipetted two times in triplicate into 96-well plates. Next, 50 μl of a freshly trypsinized and homogenized suspension of Vero cells (1:3 split of the confluent cell monolayer of a T75-flask), resuspended in DMEM containing 10% w/v fetal calf serum and antibiotics, were added. The inoculated cells were cultured for three to four days at 37° C. and observed daily for the development of cytopathic effect (CPE). CPE was compared to the positive control (virus inoculated cells) and negative controls (mock-inoculated cells or cells incubated with bivalent scFv or antibody only). The complete absence of CPE in an individual cell culture was defined as protection (=100% titer reduction).

The serum dilution giving protection in 66% percent of wells was defined as the neutralizing antibody titer. Serum from one of the two well characterized SARS-patients was used as a positive control for the neutralization assay; the clinical history of these two patients has been published (see Rickerts et al. 2003).

As shown in Table 4, the bivalent scFvs called pyBi03-001C02, pyBi03-002C02, pyBi03-003C02, pyBi03-005C02, pyBi03-006C02, pyBi03-007C02, pyBi03-008C02, pyBi03-009C02, pyBi03-010C02, pyBi03-012C02, pyBi03-013C02, pyBi03-014C02, pyBi03-015C02 were tested for SARS-CoV neutralizing activity. Furthermore, two negative controls, i.e., pyBi02-148C02 (bivalent scFv binding to antigen L6) and pyBi02-006C02 (bivalent scFv binding to thyroglobulin) and one positive control, i.e., serum from a SARS-patient, were tested for neutralizing activity. It is clear from Table 4 that the bivalent scFvs pyBi03-013C02 and pyBi03-014C02 displayed significant neutralizing activity. The bivalents neutralize the Frankfurt 1 or Frankfurt 2 strain at a dilution factor of 80 or 160 in the above-described prescreening assay. In the light of the OD values and the neutralization titer, the neutralizing antibodies are useful in the prophylaxis and/or treatment of a condition resulting from SARS infection. Neutralization data obtained with human monoclonal anti-SARS-CoV antibodies indicated that the antibodies called 03-013 and 03-014 displayed neutralizing activity (data not shown). This confirmed the above results for the bivalent single chain Fvs.

In an alternative embodiment the SARS-CoV neutralization assay is performed on Vero cells (ATCC CCL 81). The SARS-CoV strain used in the assay is the Frankfurt 1 strain (for the complete genome of this strain see EMBL-database accession # AY291315). The strain is used in a titer of $1.6 \times 10^6$ $TCID_{50}$/ml (50% tissue culture infective dose per ml). Recombinant antibodies (in phage antibody, scFv, bivalent or IgG1 format) are adjusted to a concentration of 10 µg/ml and then serially ten-fold or two-fold diluted in PBS to determine optimal inhibitory concentrations. 25 µl of the recombinant antibody are mixed with 25 µl of virus suspension (=150 $TCID_{50}$/25 µl) and incubated for one hour at 37° C. The suspension is then inoculated in triplicate onto sub-confluent Vero cells (approximately 80% density) grown in 96-well cell-culture plates. The inoculated cells are cultured for three to four days at 37° C. and observed daily for the development of cytopathic effect (CPE). CPE is compared to the positive control (virus inoculated cells) and negative controls (mock-inoculated cells or cells incubated with recombinant antibody only).

In yet another embodiment the SARS-CoV neutralization assay was performed on Vero cells (ATCC CCL 81) as follows. The SARS-CoV strain SCV-P4(5688) used in this assay was obtained from patient 5688 (who died from SARS) and then passaged four times on Vero cells (see Fouchier et al. (2003), Kuiken et al. (2003); strain is also called HK-39849 (GenBank accession number AY278491)). The virus strain was used in a titer of $2 \times 10^3$ $TCID_{50}$/ml (50% tissue culture infective dose per ml), with the titer calculated according to the method of Spearman and Kaerber which is well known to the average skilled person. Recombinant expressed human anti-SARS-CoV antibodies were screened by serially two-fold dilution in PBS starting at a concentration of 50 µg/ml (dilution range 50-0.025 µg/ml). 50 µl of virus suspension (10, 30 or 100 $TCID_{50}$/50 µl) was mixed with 50 µl of the respective recombinant human anti-SARS-CoV antibody dilution and incubated for one hour at 37° C. The suspension was then pipetted two times in triplicate into 96-well plates containing an 80% confluent monolayer of Vero cells (seeded 16 to 20 hours in advance at a density of $1 \times 10^4$ cells per well in DMEM containing 5% FBS). The Vero cells were cultured for four days at 37° C. and observed daily for the development of cytopathic effect (CPE). CPE was compared to the positive control (virus inoculated cells) and negative controls (mock-inoculated cells or cells incubated with recombinant antibody only). The complete absence of CPE in an individual cell culture was defined as protection (=100% titer reduction). The dilution giving protection in 66% percent of wells was defined as the neutralizing antibody titer. The results are shown in Table 7. On the upper row the concentration of the antibody in µg/ml is shown. In the left column of Table 7 the $TCID_{50}$ and name of the antibody used are shown. From Table 7 can be clearly deducted that the human anti-SARS-CoV antibodies called 03-013 and 03-014 contain SARS-CoV neutralizing activity. Complete protection from infectivity of 100TCID50 was reached at 170 nM for 03-013 and 42 nM for 03-014. In comparison the control antibody 02-027, a human monoclonal anti-EpCAM antibody, contained no neutralizing activity at all. The antibody called 03-006 did not show neutralizing capacity at the normal IgG dilution range, however subsequent neutralization assays revealed that 03-006 was capable of neutralizing SARS-CoV, but only at concentrations in the µM range (data not shown).

Example 8

Screening Assay for Binding of Recombinant Human Anti-SARS-Antibodies to SARS-Infected Cells in an Indirect Immunofluorescence Staining Assay (IIF)

Vero cells (ATCC CCL 81), which were grown to sub-confluency, were inoculated with a multiplicity of infection (moi) of 0.1 with the Frankfurt-1 strain of SARS-CoV. The cells were observed daily for any cyotopathic effect (CPE), which usually became first visible on day two. As soon as CPE appeared, cells were gently harvested using a cell scraper, washed once in PBS and spread in a thin layer onto microscopic slides coated with Teflon grids. The cell suspensions were allowed to dry for 30 minutes and the slides were then fixed in ice-cold acetone for 15 minutes and stored at −80° C. until further use. Recombinant human antibodies against SARS-CoV were brought to a concentration of 10 µg/ml and were then further diluted two-fold in PBS. The microscopic slides were brought to room temperature and 20 µl of the recombinant antibody suspension were spotted per field (the microscopic slides contain ten or twelve fields). Sera from patients which have been infected with SARS-CoV were used as positive controls and serum of uninfected subjects as negative controls (see Rickerts et al. 2003). Slides were incubated in a humid chamber at 37° C. for one hour and washed two times in PBS at room temperature. Working solutions of fluorescein-isothiocyanate-labeled secondary antibodies, i.e., anti-huIgG-FITC, were prepared as is known in the art. Twenty µl of the secondary antibody was applied to each spot on the slides. After a further incubation of 30 minutes at 37° C., slides were washed again twice and coverslips were mounted on the slides. Slides were read using a fluorescent microscope, comparing the specific fluorescence (number of fluorescent cells and morphology) of the slides contacted with the recombinant antibodies with the slides contacted with the positive and negative controls. In Table 5, the data of the IIF assay are presented. The recombinant human monoclonal anti-SARS-CoV antibodies called 03-014 and 03-018 showed clear cytoplasmic staining of the cells infected with SARS-CoV. Clear staining was also observed with the recombinant human monoclonal anti-SARS-CoV antibody called 03-009 (data not shown).

Example 9

Characterization of SARS-CoV Preparations Inactivated by Gamma- or UV-Irradiation All procedures were performed at room temperature unless stated otherwise. An inactivated SARS-CoV preparation (Frankfurt 1 strain) was prepared as follows. Medium from Vero cells which were infected with O.I. moi SARS-CoV strain Frankfurt 1 was harvested as soon as cyotopathic effect (CPE) was observed. Cells were once frozen at −20° C. and thawed. Cell debris was removed by centrifugation of the harvested medium for 15 minutes at 3000 rpm. The obtained supernatant was collected, spun again for 15 minutes at 3000 rpm and transferred to a clean tube. Subsequently, ultracentrifuge tubes were filled with 10 ml sterile 25% v/v glycerol in PBS. 20 ml of the cleared supernatant was gently applied on the glycerol cushion and the tubes were spun for two hours at 20,000 rpm at 4° C. in a Beckman 5W28 rotor. The supernatant was discarded and the virus pellets were resuspended in 1 ml TNE buffer (10 mM Tris-HCl pH 7.4, 1 mM EDTA, 200 mM NaCl) and stored at −80° C. Next, the resuspended virus pellets were either gamma-irradiated with a dose at 45 kGy on dry ice, or UV-irradiated at 4° C. for 15 minutes (UV-B radiation 280-350 nm; λmax 306 nm). Subsequently, they were tested for the absence of infectivity in cell culture. If absence of infectivity was established, the thus obtained inactivated SARS-CoV preparations were used for further experiments. To determine whether the isolated anti-SARS-CoV human IgG antibodies were capable of binding SARS preparations that were inactivated as described supra ELISA experiments were performed. The SARS-CoV preparations were diluted 1:250 in coating buffer (50 mM carbonate buffer, pH 9.6) and immobilized over night at 4° C. on MAXISORP™ ELISA plates. The ELISA plates were washed three times with PBS and incubated with human anti-SARS-CoV and control IgG (called 02-027) at concentrations of 1 and 5 μg/ml in PBS containing 1% BSA for one hour at room temperature. Subsequently, the plates were washed two times with PBS containing 0.05% Tween-20 and IgG bound was detected using an anti-human-IgG-HRP-conjugate (Pharmingen) at 492 nm.

Figure 5:
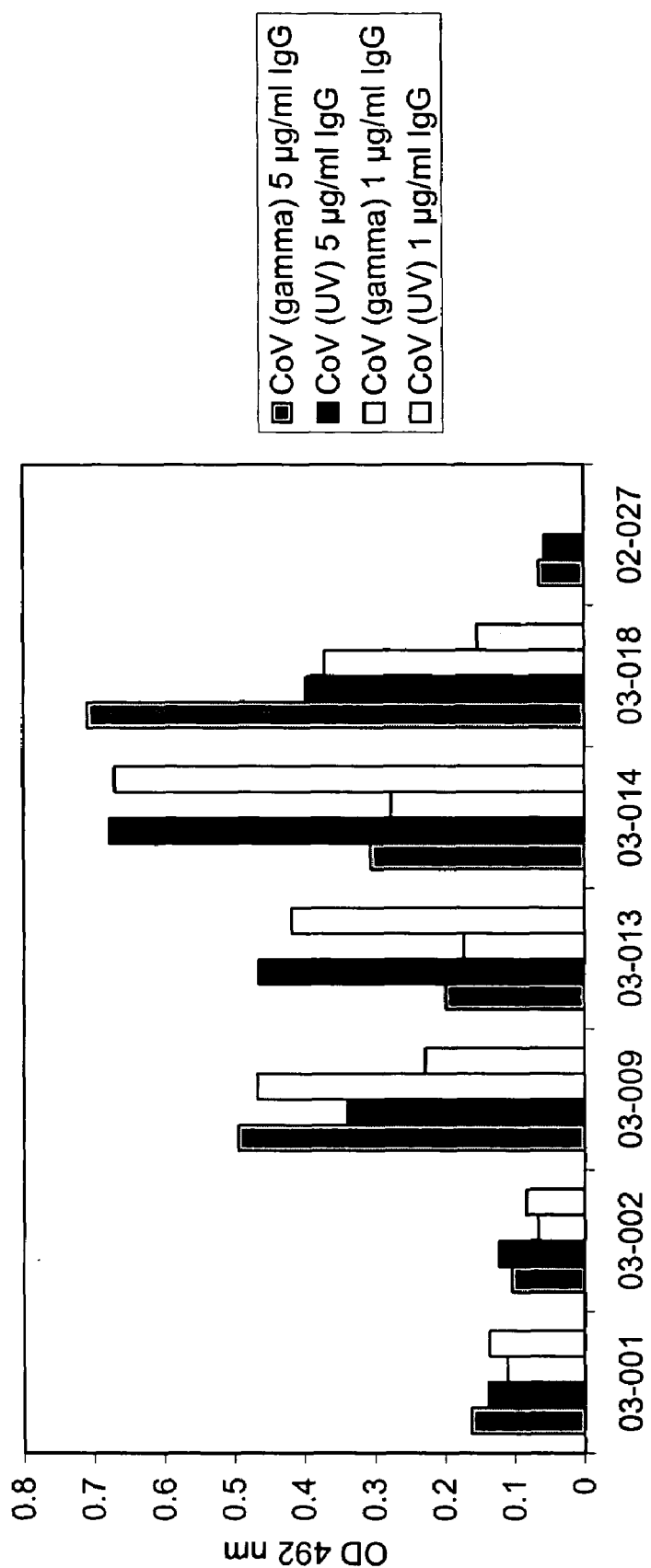
FIG. 5 shows the binding of the human monoclonal anti-SARS-CoV antibodies called 03-001, 03-002, 03-009, 03-013, 03-014, 03-018 and the control antibody called 02-027 (a human monoclonal anti-EPCAM antibody) to an UV- or gamma-irradiated SARS-CoV preparation. From each antibody 1 and 5 μg/ml was tested. On the X-axis the antibodies and on the Y-axis the absorbance (OD) at 492 nm is shown. For each anti-SARS-CoV antibody is shown from left to right the binding of 5 μg/ml of the antibody to the gamma-irradiated preparation, the binding of 5 μg/ml of the antibody to the UV-irradiated preparation, the binding of 1 μg/ml of the antibody to the gamma-irradiated preparation and the binding of 1 μg/ml of the antibody to the UV-irradiated preparation. The binding of the control antibody to the UV- and gamma-irradiated SARS-CoV preparation was only tested at a concentration of 5 μg/ml.

As shown in FIG. 5, the anti-SARS-CoV antibody called 03-001 and 03-002 were capable of binding both the UV- and gamma-irradiated SARS-CoV preparation to a similar extent. In contrast, the antibodies called 03-009 and 03-018 preferably bound to the gamma-irradiated SARS-CoV preparation, whereas the antibodies called 03-013 and 03-014 preferably bound to the UV-irradiated SARS-CoV preparation. The above might indicate that the antibodies called 03-009 and 03-018 bind a viral antigen that becomes more exposed upon the vigorous gamma-irradiation of the virus. The above might also indicate that the gamma-irradiation might damage the antigen recognized by the antibodies 03-013 and 03-014.

Example 10

Characterization of Anti-SARS-CoV IgG Antibodies in Sandwich ELISA

To determine if upon denaturation of a SARS-CoV preparation, more antigen becomes accessible for the isolated recombinant human monoclonal anti-SARS-CoV antibodies and to determine which antigens are detected by the human monoclonal anti-SARS-CoV antibodies, the following sandwich ELISA was performed. For the detection of bound antigens different anti-SARS-CoV rabbit antisera were used. The sandwich ELISA was performed as follows. Human anti-SARS-CoV antibodies or the control antibody called 02-300 (an antibody against CD46) were immobilized over night at 4° C. to MAXISORP™ ELISA plates at a concentration of 5 μg/ml in coating buffer (50 mM carbonate buffer, pH 9.6). The plates were washed three times with PBS and blocked with PBS containing 1% BSA. Next, a gamma-irradiated SARS-CoV preparation prepared as described herein was denatured by diluting the preparation 1:10 in RIPA buffer (150 mM NaCl, 1% Nonidet P-40, 0.5% deoxycholate, 0.1% sodium dodecyl sulphate, 50 mM Tris, pH 8.0) followed by an incubation of one hour at room temperature. Subsequently, the denatured virus preparation was diluted 1:10 in PBS containing 1% BSA and the immobilized human IgGs were incubated with the denatured virus preparation for one hour at room temperature. To recognize which proteins of the SARS-CoV were detected by the immobilized recombinant human monoclonal anti-SARS-CoV antibodies polyclonal rabbit antibodies recognizing the complete SARS-CoV, the spike protein of SARS-CoV (Imgenex IMG-542 or IMG-557) or the nucleocapsid protein of SARS-CoV (Imgenex IMG-543). Finally, bound rabbit IgG was detected (using OD 492 nm measurement) using an anti-rabbit-IgG-HRP-conjugate (Dako).

Figure 6A:
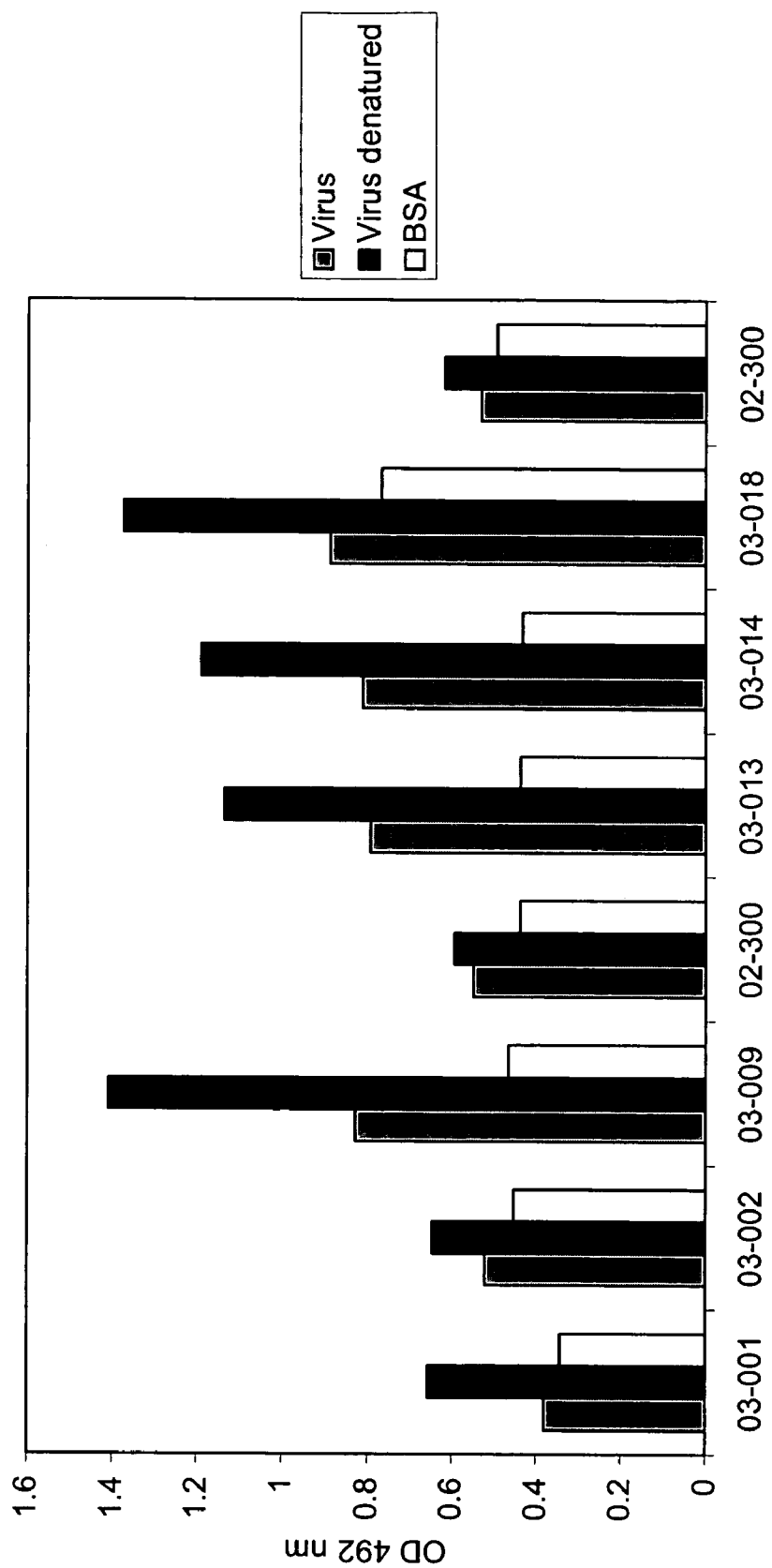
FIGS. 6A-D show sandwich ELISAs of the immobilized recombinant human monoclonal anti-SARS-CoV antibodies called 03-001, 03-002, 03-009, 03-013, 03-014, 03-018 and the control antibody 02-300 (an antibody directed against CD46) with from left to right a SARS-CoV preparation, a denatured SARS-CoV preparation and BSA. On the Y-axis the absorbance (OD) at 492 nm is shown.
Figure 6B:
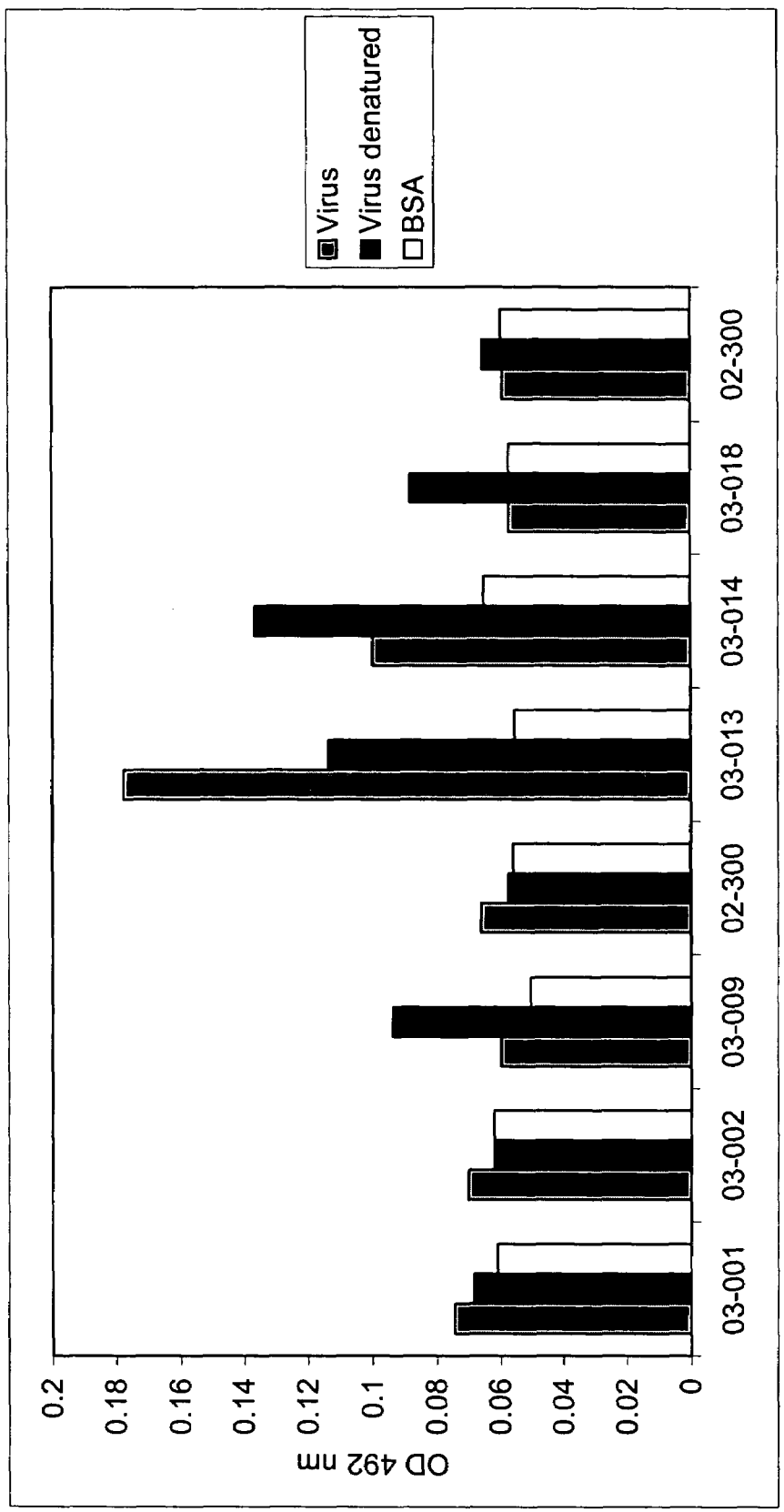
Figure 6C:
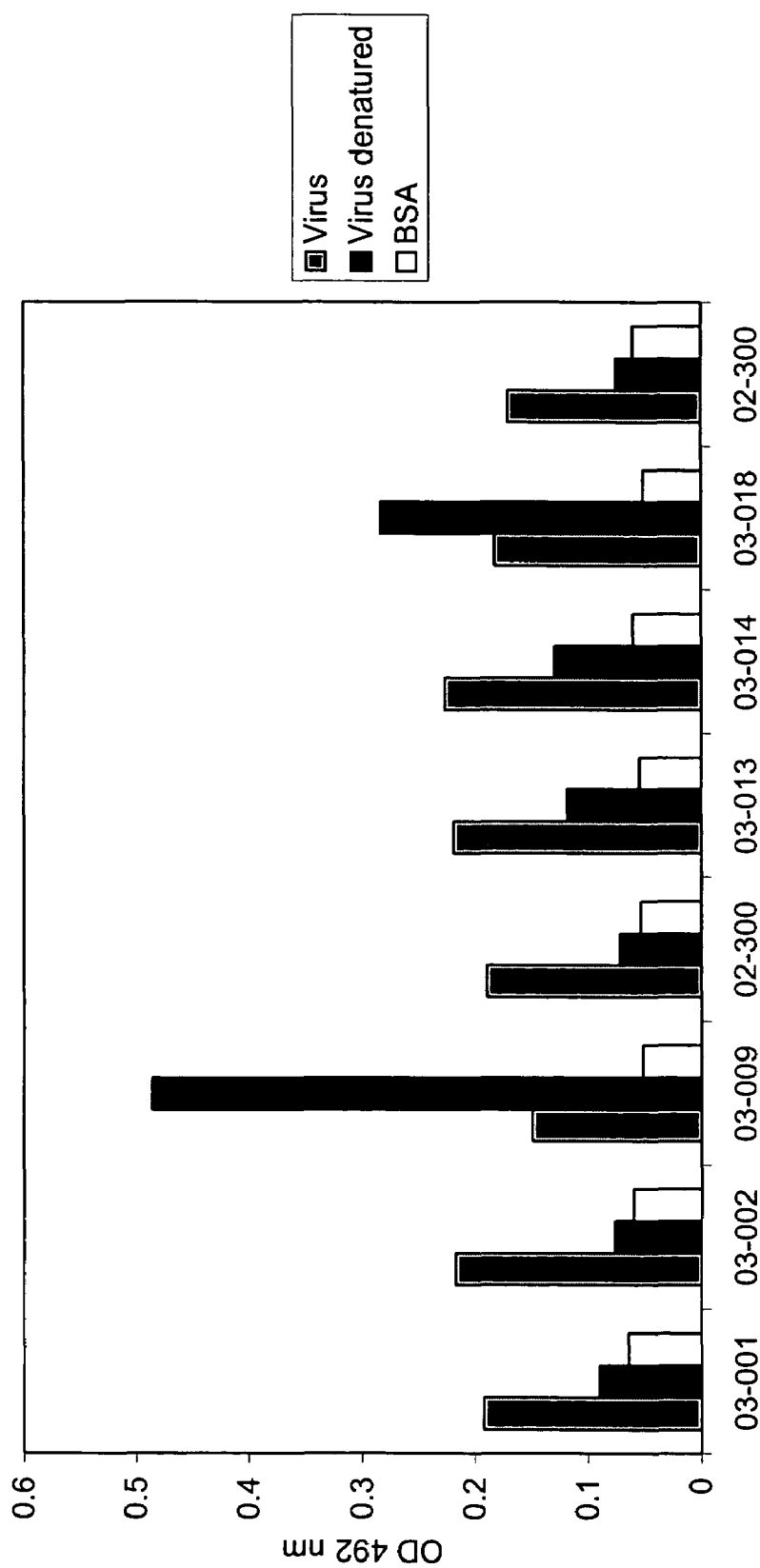
Figure 6D:
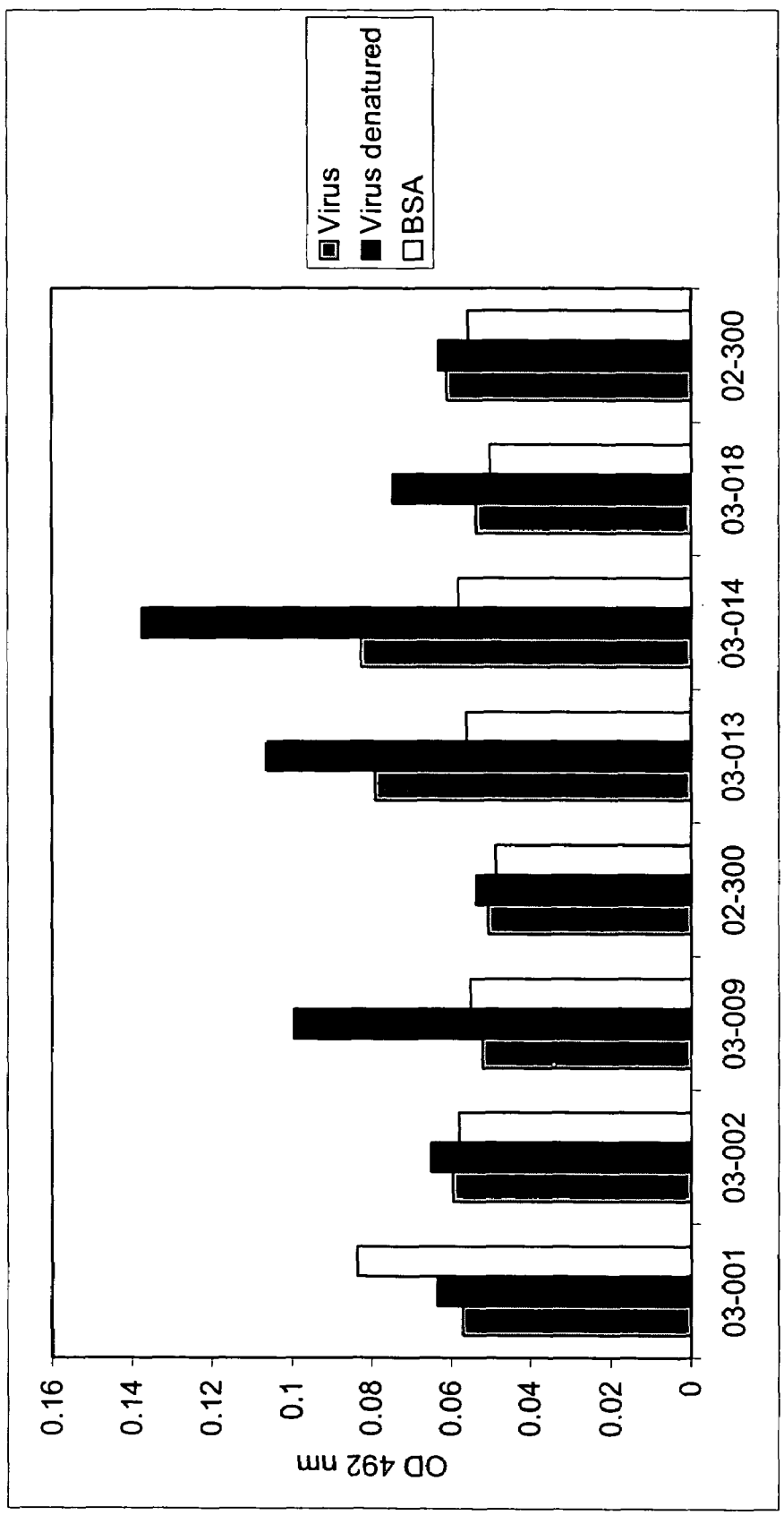

As shown in FIG. 6A (detection by means of a polyclonal serum against complete SARS-CoV), the recombinant human monoclonal anti-SARS-CoV antibodies called 03-009, 03-013, 03-014 and 03-018 were all capable of binding both a native and a denatured SARS-CoV preparation. The increased signal after denaturation might have been caused by the exposure of more antigenic sites upon denaturation. When detection was performed by means of two polyclonal rabbit antibodies against the SARS-CoV spike protein (FIGS. 6B and 6D for the antibodies called IMG-542 and IMG-557, respectively), the values for the antibodies called 03-013 and 03-014 were higher compared to those for 03-009 and 03-018, which indicated that the antibodies called 03-013 and 03-014 are directed to the spike protein of SARS-CoV. When detection was performed using polyclonal antibodies against the SARS-CoV nucleocapsid protein (FIG. 6C for the antibody called IMG-543), the values for the antibodies called 03-009 and 03-018 were higher compared to the values of the antibodies called 03-013 and 03-014, especially when the virus was denatured, indicating that 03-009 and 03-018 are directed to the nucleocapsid (N) protein of SARS-CoV. Based on the above it might be concluded that the recombinant human monoclonal anti-SARS-CoV antibodies called 03-009 and 03-018 are directed to the nucleocapsid protein of SARS-CoV, while the recombinant human monoclonal anti-SARS-CoV antibodies called 03-013 and 03-014 are directed to the spike protein of SARS-CoV.

Example 11

Identification of Epitopes Recognized by Recombinant Human Anti-SARS-CoV Antibodies by PEPSCAN-ELISA Fifteen-mer linear and looped/cyclic peptides were synthesized from proteins of SARS-CoV and screened using credit-card format mini-PEPSCAN cards (455 peptide formats/card) as described previously (see inter alia WO 84/03564, WO 93/09872, Slootstra et al. 1996). All peptides were acetylated at the amino terminus. In short, series of overlapping peptides, which were either in linear form or in looped/cyclic form, of all the (potential) proteins of SARS-CoV Urbani, these proteins being called spike protein (the protein-id of the surface spike glycoprotein in the EMBL-database is AAP13441), protein X1 (the protein-id of protein X1 is AAP13446), protein X2 (the protein-id of protein X1 is AAP13447), E protein (the protein-id of the small envelope protein, E protein, is AAP13443), M protein (the protein-id of the membrane protein, M protein, is AAP13444), protein X3 (the protein-id of protein X3 is AAP13448), protein X4 (the protein-id of protein X4 is AAP13449), protein X5 (the protein-id of protein X5 is AAP13450), and N protein (the protein-id of the nucleocapsid protein, N protein, is AAP13445), were produced and tested for binding to the recombinant human anti-SARS-CoV antibodies of the invention by means of PEPSCAN analysis.

Because the Urbani proteins indicated above are also found in identical or highly homologous form in other SARS-CoV strains, the antigenic peptides found in the analysis method may not only be used for detection of the SARS-CoV strain Urbani and the prevention and/or treatment of a condition resulting from the SARS-CoV strain Urbani, but may also be useful in detecting SARS-CoV in general and preventing and/or treating a condition resulting from SARS-CoV in general. The protein-id of the surface spike glycoprotein of for instance the SARS-CoV strains TOR2, Frankfurt 1 and HSR 1 in the EMBL-database is AAP41037, AAP33697 and AAP72986. The accession number in the EMBL-database of the complete genome of the strains TOR2, Frankfurt 1 and HSR 1 is AY274119, AY291315 and AY323977, respectively. Under these accession numbers the amino acid sequence of the other (potential) proteins of these strains can be found.

As indicated above, several proteins of SARS-CoV, such as inter alia the spike protein and the N protein, are shared by all SARS-CoV strains. However, the strains TOR2, Frankfurt 1 and HSR 1 contain open reading frames encoding (potential) proteins that are not present in the SARS-CoV strain Urbani. In the SARS-CoV strain called TOR2 these (potential) proteins are called Orf9, Orf10, Orf13 and Orf14. The first three of these (potential) proteins are also found in the SARS-CoV strains called Frankfurt 1 and HSR 1. In these strains the (potential) proteins are called Orf7b, Orf8a and Orf9b, respectively. The coding sequence (CDS) of the (potential) proteins of SARS-CoV TOR2 is shown under EMBL-database accession number AY274119, the coding sequence (CDS) of the (potential) proteins of SARS-CoV HSR 1 can be found under accession number AY323977, the coding sequence (CDS) of the (potential) proteins of SARS-CoV Frankfurt 1 can be found under accession number AY291315. Series of overlapping peptides, which were either in linear form or in looped/cyclic form, of all the (potential) proteins of SARS-CoV TOR2 were also produced and tested for binding to the recombinant human anti-SARS-CoV antibodies of the invention by means of PEPSCAN analysis. Because the TOR2 proteins indicated above are also found in identical or highly homologous form in several other SARS-CoV strains, such as for instance the strains called Frankfurt 1 and HSR 1, the peptides found in the analysis method may not only be used for detection of the SARS-CoV strain TOR2 and the prevention and/or treatment of a condition resulting from the SARS-CoV strain TOR2, but may also be useful in detecting SARS-CoV strains which express these (potential) proteins and preventing and/or treating a condition resulting from SARS-CoV which express these (potential) proteins.

In all looped peptides position-2 and position-14 were replaced by a cysteine (acetyl-XCXXXXXXXXXXXCX-minicard). If other cysteines besides the cysteines at position-2 and position-14 were present in a prepared peptide, the other cysteines were replaced by an alanine. The looped peptides were synthesized using standard Fmoc-chemistry and deprotected using trifluoric acid with scavengers. Subsequently, the deprotected peptides were reacted on the cards with an 0.5 mM solution of 1,3-bis(bromomethyl)benzene in ammonium bicarbonate (20 mM, pH 7.9/acetonitril (1:1 (v/v)). The cards were gently shaken in the solution for 30 to 60 minutes, while completely covered in the solution. Finally, the cards were washed extensively with excess of $H_2O$ and sonicated in disrupt-buffer containing 1% SDS/0.1% beta-mercaptoethanol in PBS (pH 7.2) at 70° C. for 30 minutes, followed by sonication in $H_2O$ for another 45 minutes.

Recombinant human anti-SARS-CoV antibodies were tested for binding to each linear and looped peptide in a PEPSCAN-based enzyme-linked immuno assay (ELISA). The 455-well creditcard-format polypropylene cards, containing the covalently linked peptides, were incubated with the antibodies (1 µg/ml; diluted in blocking solution which contains 5% horse-serum (v/v) and 5% ovalbumin (w/v)) (4° C., overnight). After washing, the peptides were incubated with anti-human antibody peroxidase (dilution 1/1000) (one hour, 25° C.), and subsequently, after washing, the peroxidase substrate 2,2'-azino-di-3-ethylbenzthiazoline sulfonate (ABTS) and 2 µl/ml 3% $H_2O_2$ were added. Controls (for linear and looped) were incubated with anti-human antibody peroxidase only. After one hour, the color development was measured. The color development of the ELISA was quantified with a CCD-camera and an image processing system. The setup consisted of a CCD-camera and a 55 mm lens (Sony CCD Video Camera XC-77RR, Nikon micro-nikkor 55 mm f/2.8 lens), a camera adaptor (Sony Camera adaptor DC-77RR) and the Image Processing Software package Optimas, version 6.5 (Media Cybernetics, Silver Spring, Md. 20910, U.S.A.). Optimas runs on a pentium II computer system.

The recombinant human anti-SARS-CoV-antibodies were tested for binding to the 15-mer linear and looped/cyclic peptides synthesized as described supra. Relevant binding of a peptide to a recombinant human anti-SARS-CoV antibody was calculated as follows. The average OD-value for each antibody was calculated for the respective proteins (sum of OD-values of all peptides/total number of peptides). Next, the standard deviation of this average was calculated. The standard deviation was multiplied by two and the obtained value was added to the average value to obtain the correction factor. The OD-value of each peptide was then divided by this correction factor. If a value of 0.9 or higher was found, then relevant binding was considered to be present between the specific peptide and the respective antibody. Particularly interesting appear to be domains comprising several relevant peptides. These domains are indicated (colored grey) in Table 6. The recombinant human anti-SARS-CoV antibody called 03-018 reacted with peptides of the nucleocapsid (N) protein. The peptides recognized include NGPQSNQRSAPRITF (SEQ ID NO:97), GPQSNQRSAPRITFG (SEQ ID NO:98), PQSNQRSAPRITFGG (SEQ ID NO:99), QSNQRSAPRIT-FGGP (SEQ ID NO:100), SNQRSAPRITFGGPT (SEQ ID NO:101), NQRSAPRITFGGPTD (SEQ ID NO:102), QRSAPRITFGGPTDS (SEQ ID NO:103), RSAPRITFG-GPTDST (SEQ ID NO:104), SAPRITFGGPTDSTD (SEQ ID NO:105), APRITFGGPTDSTDN (SEQ ID NO:106), PRITFGGPTDSTDNN (SEQ ID NO:107), RITFGGPTD-STDNNQ (SEQ ID NO:108) and ITFGGPTDSTDNNQN (SEQ ID NO:109). The highest binding of the recombinant human anti-SARS-CoV antibody called 03-018 was with a continuous series of linear and looped peptides starting with the sequence GPQSNQRSAPRITFG (SEQ ID NO:98) and ending with the sequence RSAPRITFGGPTDST (SEQ ID NO:104), thereby mapping the minimal binding site of 03-018 to the sequence RSAPRITFG (SEQ ID NO:468), which corresponds with residues 11-19 of the N protein. Strikingly, this linear epitope is conserved in the N protein sequence of all published human SARS-CoV and animal SARS-CoV-like isolates, but is absent in other members of the family of Coronaviridae. The PEPSCAN analysis further revealed that the recombinant human N protein specific anti-SARS-CoV antibody called 03-009 did not recognize a stretch of linear or looped amino acids on the N protein suggesting that this antibody recognizes a non-linear/conformational epitope of the N protein. All of the above peptides or parts thereof are useful in the detection of SARS-CoV in general.

Example 12

Selection of Single-Chain Phage Antibodies Specifically Recognizing Proteins Derived from SARS-CoV Using Transfected HEK293T-Cells In another assay the single-chain phage antibodies are analyzed for their ability to bind HEK293T cells that recombinantly express proteins of the SARS-CoV. To this purpose HEK293T cells are transfected with a plasmid carrying a cDNA sequence encoding the envelope (E) protein, membrane (M) protein or spike (S) protein from SARS-CoV strain Frankfurt 1 or with the empty vector. Stable transfectants are selected using standard techniques known to a person skilled in the art (see J. E. Coligan, B. M. Dunn, H. L. Ploegh, D. W. Speicher and P. T. Wingfield (eds.) (2001) Current protocols in protein science, volume I, John Wiley & Sons, Inc., New York). For flow cytometry analysis, single-chain phage antibodies are first blocked in an equal volume of 4% PBS-M for 15 minutes at 4° C. prior to the staining of the transfected HEK293T cells. The blocked phage antibodies are added to control transfected HEK293T cells and HEK293T cells transfected with the SARS-CoV proteins mentioned above. The binding of the single chain phage antibodies to the cells is visualized using a biotinylated anti-M 13 antibody (Santa Cruz Biotechnology) followed by streptavidin-phycoerythrin (Caltag).

In yet another assay scFv antibodies were analyzed for their ability to bind to portions of the spike (S) protein and the complete nucleocapsid (N) protein of SARS-CoV. The cDNA encoding the S protein of the SARS-CoV strain Frankfurt 1 was adapted to the codon-bias of Homo sapiens genes and gene-optimized for optimal expression by Geneart (Regensburg, Germany). The codon-optimized nucleotide sequence of the S protein is shown in SEQ ID NO:462. The amino acid sequence encoded by this codon-optimized nucleotide sequence is shown in SEQ ID NO:463.

DNA encoding for the N-terminal 565 amino acids (portion called S565) was cloned as a KpnI-BamHI fragment in pAdapt (Havenga et al., 2001) that was modified by insertion of the polylinker of the vector called pcDNA3.1/myc-His C (Invitrogen) (vector called pAdapt/myc-His C).

DNA encoding for the N-terminal 826 amino acids (portion called S826) was cloned as KpnI-EcoRV fragment in pAdapt that was modified by insertion of the polylinker of the vector called pcDNA3.1/myc-His B (Invitrogen) (vector called pAdapt/myc-His B).

DNA encoding for the N-terminal 1195 amino acids (portion called S1195) is constructed as follows. A DNA fragment is amplified from codon-optimized S protein cDNA using the oligonucleotide primers: XhoISpikeRevCOG 5'-gttcctc-gaggggccacttgatgtactgc-3' (SEQ ID NO:464) and SpikeCOG seq 1 5'-ccaggtgaagcagatgta-3' (SEQ ID NO:465). The resulting fragment is cloned as BstEII-XhoI fragment together with a KpnI-BstEII fragment derived from the codon-optimized S protein cDNA (alternatively, a restriction site other than BstEII, which is unique in the amplified fragment can be used) in pAdapt that is modified by insertion of the polylinker of the vector called pcDNA3.1/myc-His A (Invitrogen) (vector called pAdapt/myc-His A).

A fragment corresponding to amino acid residues 318-510 of the S protein (portion called S318-510) was amplified on S gene cDNA using the oligonucleotide primers: EcoRIspike-For318 5'-cctggaattctccatggccaacatcaccaacc-3' (SEQ ID NO:469) and XbaIspikeRev510 5'-gaagggccctctagacacggtg-gcagg-3' (SEQ ID NO:470). The resulting fragment was digested with EcoRI-XbaI and cloned into pHAVT20/myc His A to yield pHAVT20/myc-His A S318-510. In this vector expression of fragment S318-510 fused to the HAVT20 leader sequence was under control of the human, full-length, immediate-early CMV promoter.

DNA encoding for the nucleocapsid protein was amplified from total random hexamer cDNA from the SARS-CoV strain Frankfurt 1 using the oligonucleotide primers KpnINC-For 5'-cttggtaccgccaccatgtctgataatggacc-3' (SEQ ID NO:466) and XbaTNCRev 5'-gttctctagatgcctgagttgaatcagc-3' (SEQ ID NO:467) and cloned as KpnI-XbaI fragment in pAdapt/myc-His A. DNA transfections were performed in HEK293T cells for transient expression using standard techniques. The S protein derived fragments, and nucleocapsid (N) protein were used directly from culture supernatant or cell lysates. Alternatively, the fragments and nucleocapsid (N) protein were purified from culture supernatant using Ni-NTA (QIAGEN™).

Figure 8:
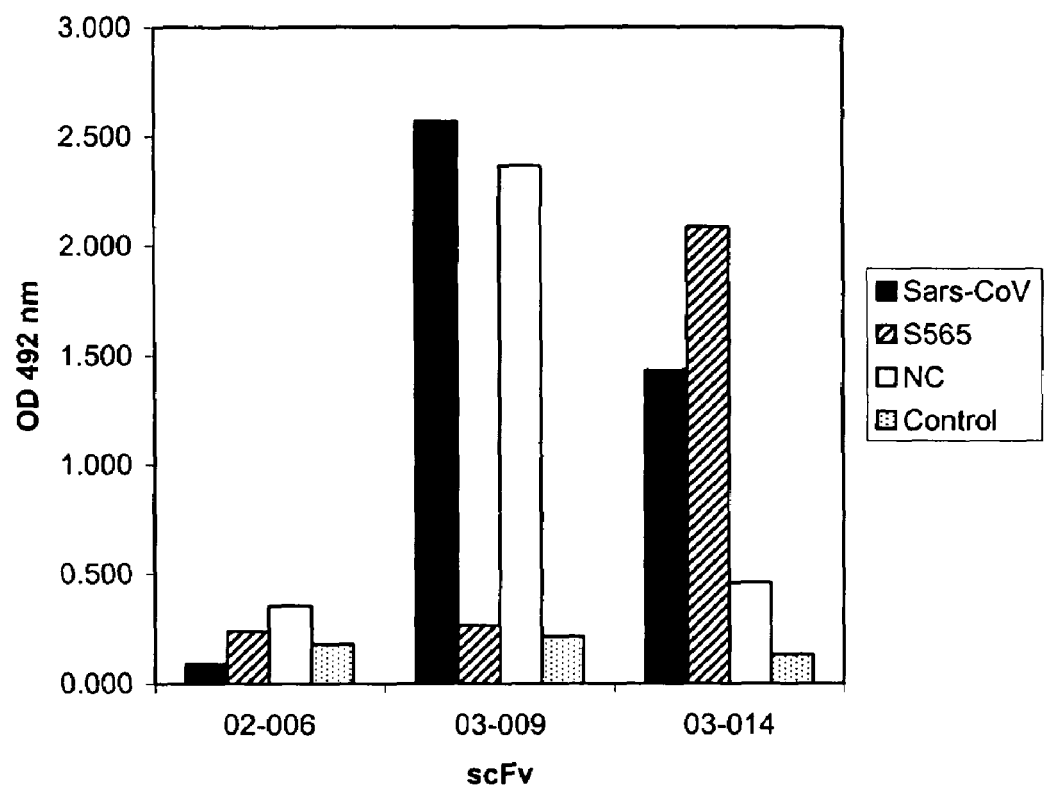
FIG. 8 shows the ELISA binding of SC03-009, SC03-014 and the control SC02-006 to a SARS-CoV preparation, the S565 fragment (amino acids 1-565 of the S protein of SARS-CoV), the nucleocapsid protein of SARS-CoV and a control protein. On the Y-axis the absorbance (OD) at 492 nm is shown.

The ELISA for the detection of scFv antibodies to the S protein derived fragments or the nucleocapsid (N) protein was performed as follows. Wells of ELISA plates were coated overnight with 5 µg/ml anti-myc antibody in 50 mM bicarbonate buffer pH 9.6. In case of the UV-inactivated SARS-CoV preparation, the wells were coated with the preparation as described above. The wells of the plates were washed three times with PBS containing 0.05% Tween and blocked for two hours at 37° C. with PBS containing 1% BSA. The wells coated with anti-myc antibody were incubated with culture supernatant or cell lysate containing the myc-tagged fragment S565 or nucleocapsid (N) protein diluted in PBS containing 1% BSA for one hour at room temperature. The wells were washed three times with PBS containing 0.05% Tween. Next, the scFvs SC03-014 and SC03-009 were diluted in PBS containing 0.05% Tween and were incubated for one hour at room temperature. The wells were washed three times with PBS containing 0.05% Tween and incubated for 1 hour at room temperature using an anti-VSV-HRP conjugate (for scFv). As shown in FIG. 8, SC03-009 and SC03-014 were both capable of binding an inactivated SARS-CoV preparation in ELISA in contrast to the control scFv SC02-006 (Anti-thyroglobulin scFv). Testing the reactivity of the scFvs with SARS-CoV derived proteins or portions captured through their myc-tag revealed that SC03-009 was capable of binding to the nucleocapsid (N) protein, but not the spike fragment S565 and an irrelevant control myc-tagged protein (the bivalent scFv called 02-300). In contrast, SC03-014 only reacted with the S565 fragment and not with the nucleocapsid (N) protein and the control protein 02-300. For ELISA experiments with IgGs (see below) a murine anti-Hu-IgG HRP conjugate instead of an anti-VSV-HRP conjugate was used. Development was done with O-phenylenediamine substrate, the reaction was stopped by the addition of 1M $H_2SO_4$ and the absorbance was measured at 492 nm. Similar results were obtained in ELISA experiments when the wells coated with anti-myc antibody were incubated with myc-tagged fragment S565 or nucleocapsid (N) protein which was first purified from culture supernatant or cell lysate using Ni-NTA (data not shown).

Figure 9:
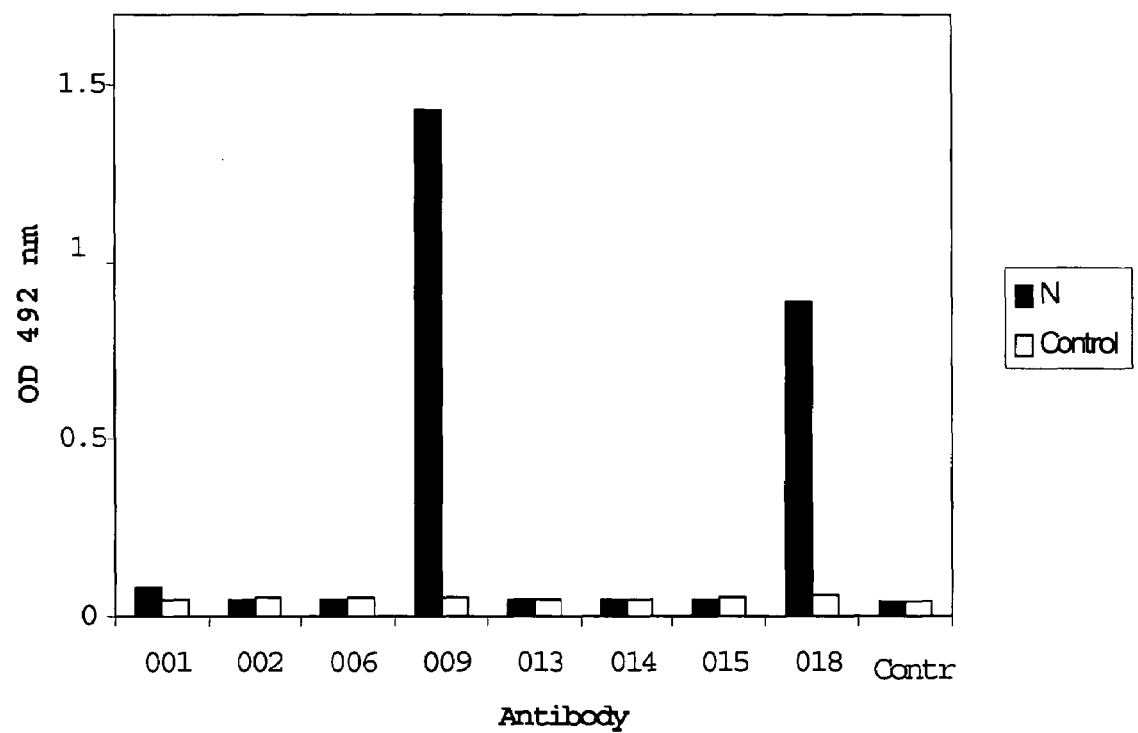
FIG. 9 shows the ELISA binding of antibodies 03-001, 03-002, 03-006, 03-009, 03-013, 03-014, 03-015, 03-018 and the control antibody 02-027 (anti-EPCAM) to the nucleocapsid protein of SARS-CoV and a control protein. On the Y-axis the absorbance (OD) at 492 nm is shown.

To further investigate binding to the SARS coronavirus fragments and proteins, the following experiments were performed with the monoclonal antibodies 03-001, 03-002, 03-006, 03-009, 03-013, 03-014, 03-015 and 03-018. Full length N protein from transfected HEK293T cell lysates was captured on an ELISA plate by means of an anti-myc antibody as described above and incubated with the above mentioned IgG molecules. FIG. 9 shows that the monoclonal antibodies 03-009 and 03-018 bound specifically to the N protein, while not binding the control protein, i.e., bivalent scFv 02-300.

Figure 10:
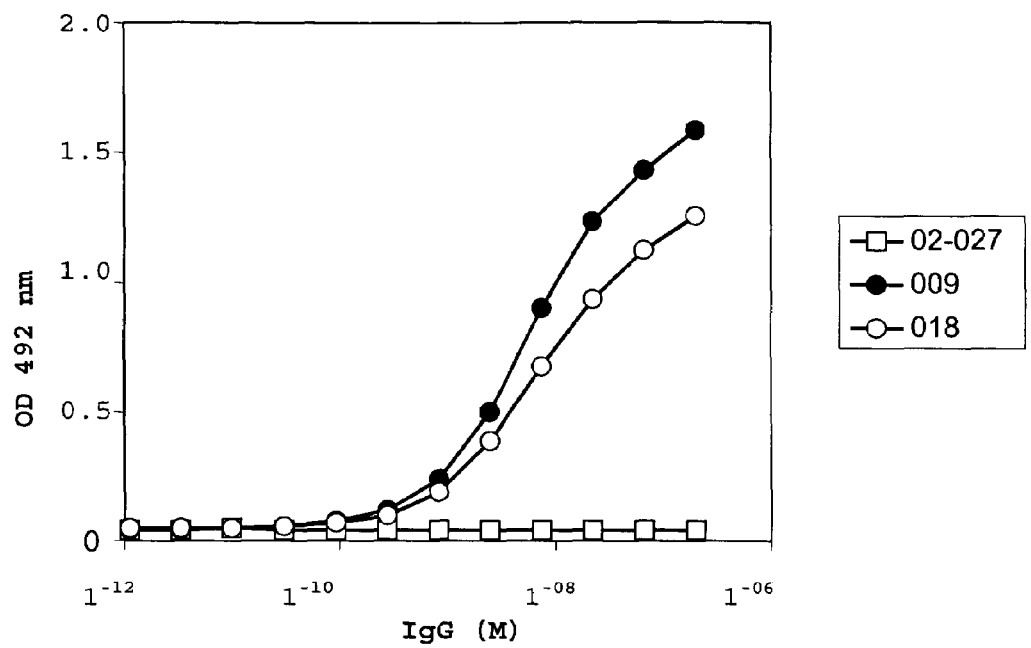
FIG. 10 shows the ELISA binding of dilutions of antibodies 03-009, 03-018 and the control antibody 02-027 to the nucleocapsid protein of SARS-CoV. On the Y-axis the absorbance (OD) at 492 nm is shown and on the X-axis the amount of antibody in M.

In order to rank the affinities of the monoclonal antibodies binding the N protein, a titration of IgG concentration (by diluting the antibodies in PBS containing 1% ELK) followed by ELISA as described above was performed. Titration of the monoclonal antibodies showed that 03-009 bound better to the N protein than 03-018 (see FIG. 10). This may reflect a difference in affinity.

Figure 11:
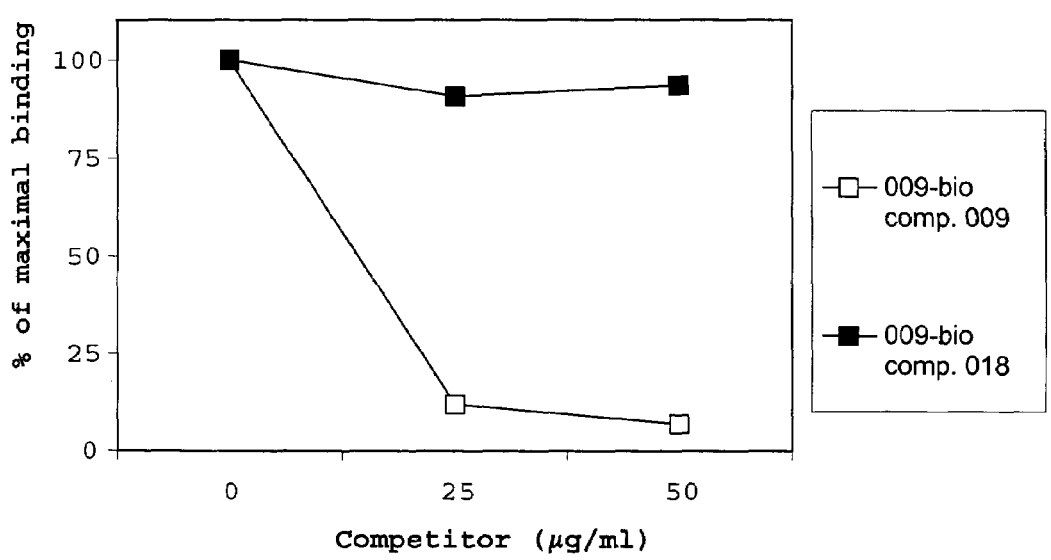
FIG. 11 shows a competition ELISA for binding to the nucleocapsid protein of SARS-CoV between biotinylated antibody 03-009 without competing antibody or with 25 or 50 μg/ml competing antibody 03-009 or 03-018. On the Y-axis the % of maximal binding is shown and on the X-axis the amount of the competing antibody in μg/ml.

To further explore the antibody binding sites within the N protein, a competition ELISA on immobilized N protein was performed. Captured N protein was incubated with 1 µg/ml (non-saturating) biotinylated antibody 03-009 without competing antibody or in the presence of a 25- or 50-fold excess of competing antibody (antibody 03-009 or 03-018). Bound biotinylated antibody 03-009 was detected with streptavidin-conjugated-HRP (BD Pharmingen) and developed as described above. Results (see FIG. 11) show that binding of monoclonal antibody 03-009 is unaffected in the presence of a 25- or 50-fold excess of unlabeled monoclonal antibody 03-018. This demonstrated that the antibodies 03-009 and 03-018 do not compete with each other for binding to the N protein and recognize different epitopes.

Subsequently, the interaction of the above antibodies with the S protein was evaluated. Binding of the antibodies to the full length S protein expressed on HEK293T cells was first investigated by flow cytometry. The transfected cells were incubated with human IgGs at a concentration of 10 µg/ml for one hour on ice. Cells were washed three times, incubated for 45 minutes with biotinylated goat anti-human IgG followed by a ten minute incubation with streptavidin-conjugated phycoerythin. The analysis showed that the monoclonal antibodies 03-006, 03-013, 03-014 and 03-015 specifically bound S protein transfected HEK293T cells (see FIG. 12).

To further localize the binding site of these antibodies within the S protein, binding to a recombinant soluble fragment encompassing S protein residues 1-565 (S565) was tested by means of ELISA as described above. Within the antibody panel binding the full length S protein on the HEK293T cells, all antibodies except 03-015 bound to fragment S565 (see FIG. 12).

Figure 12:
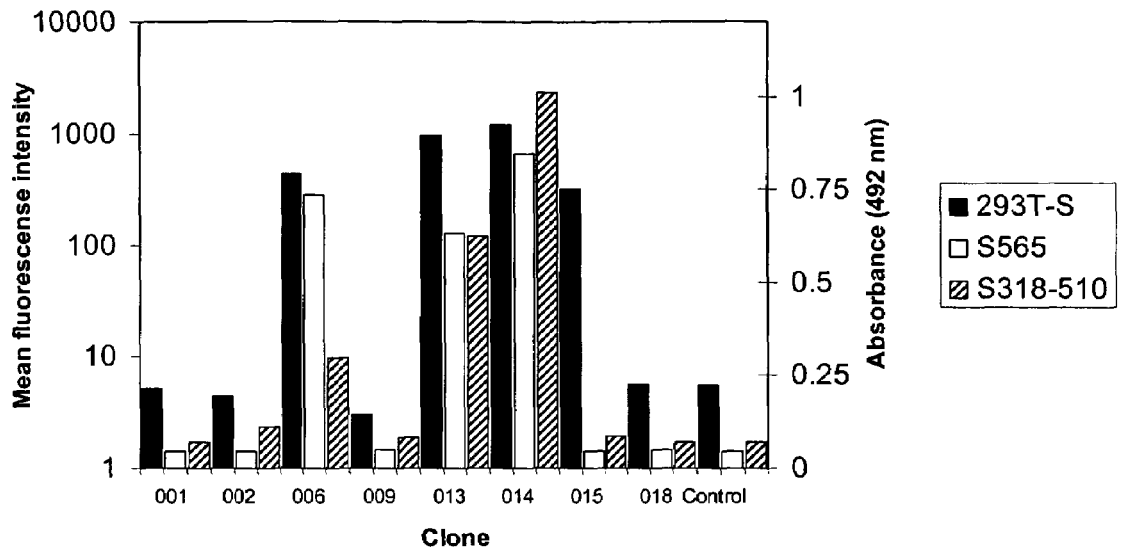
FIG. 12 shows FACS binding of the antibodies 03-001, 03-002, 03-006, 03-009, 03-013, 03-014, 03-015, 03-018 and the control antibody 02-027 (anti-EPCAM) to the full length S protein expressed on HEK293T cells (left column) and ELISA binding of these antibodies to the S565 fragment (amino acids 1-565 of the S protein of SARS-CoV; middle column) and S318-510 fragment (amino acids 318-510 of the S protein of SARS-CoV; right column). On the right Y-axis the absorbance (OD) at 492 nm is shown and on the left Y-axis the mean fluorescence intensity is shown.
Figure 13:
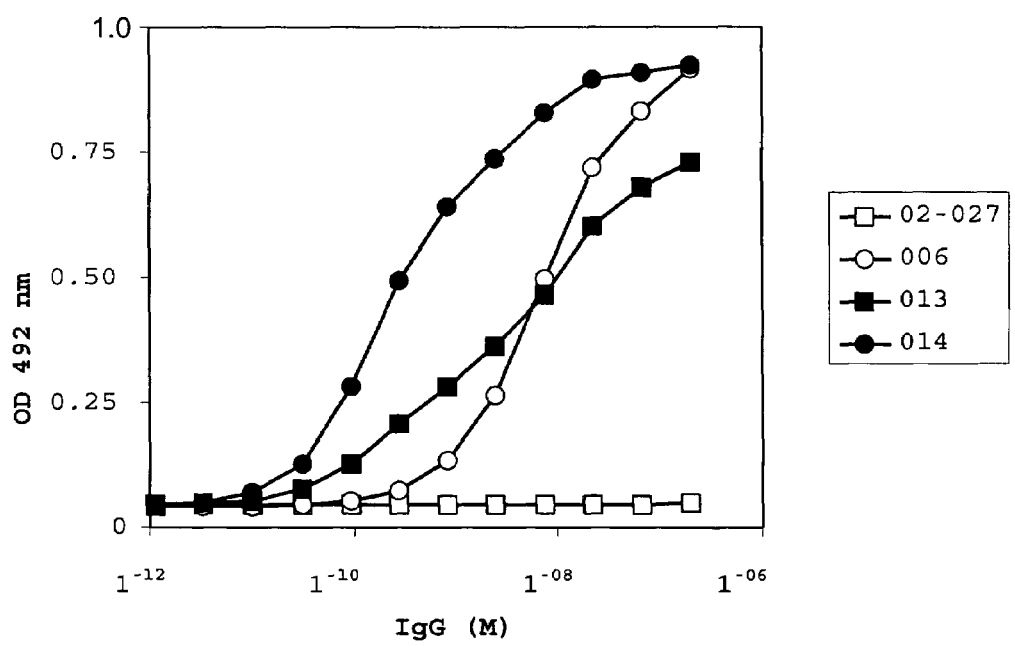
FIG. 13 shows the ELISA binding of dilutions of antibodies 03-006, 03-013, 03-014 and the control antibody 02-027 to the S565 fragment of the S protein of SARS-CoV. On the Y-axis the absorbance (OD) at 492 nm is shown and on the X-axis the amount of antibody in M.
Figure 14:
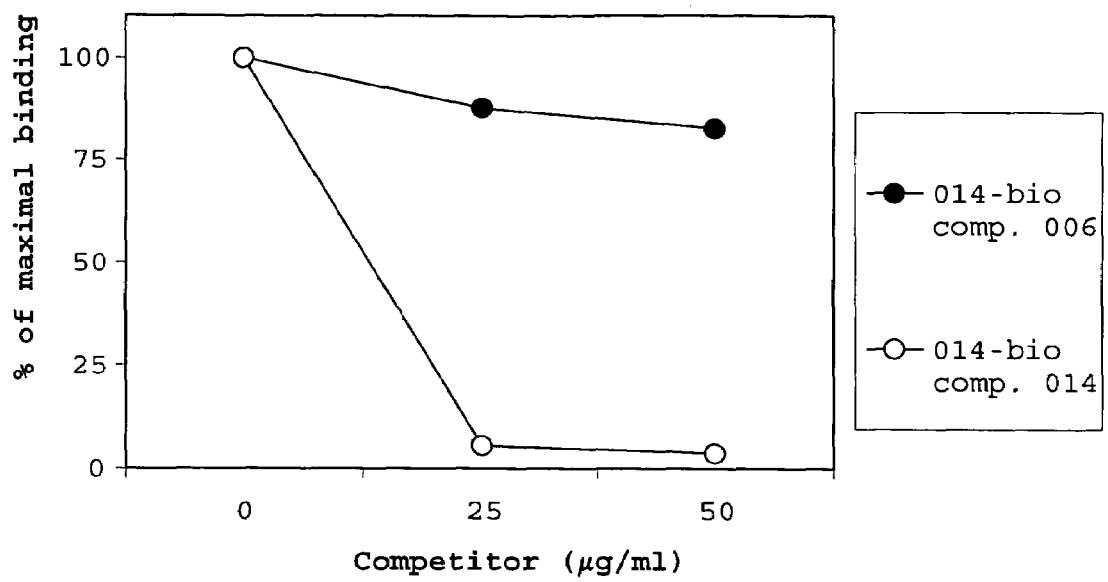
FIG. 14 shows a competition ELISA for binding the S565 fragment of the S protein of SARS-CoV between biotinylated antibody 03-014 without competing antibody or with 25 or 50 μg/ml competing antibody 03-006 or 03-014. On the Y-axis the % of maximal binding is shown and on the X-axis the amount of the competing antibody in μg/ml is indicated.
Figure 15:
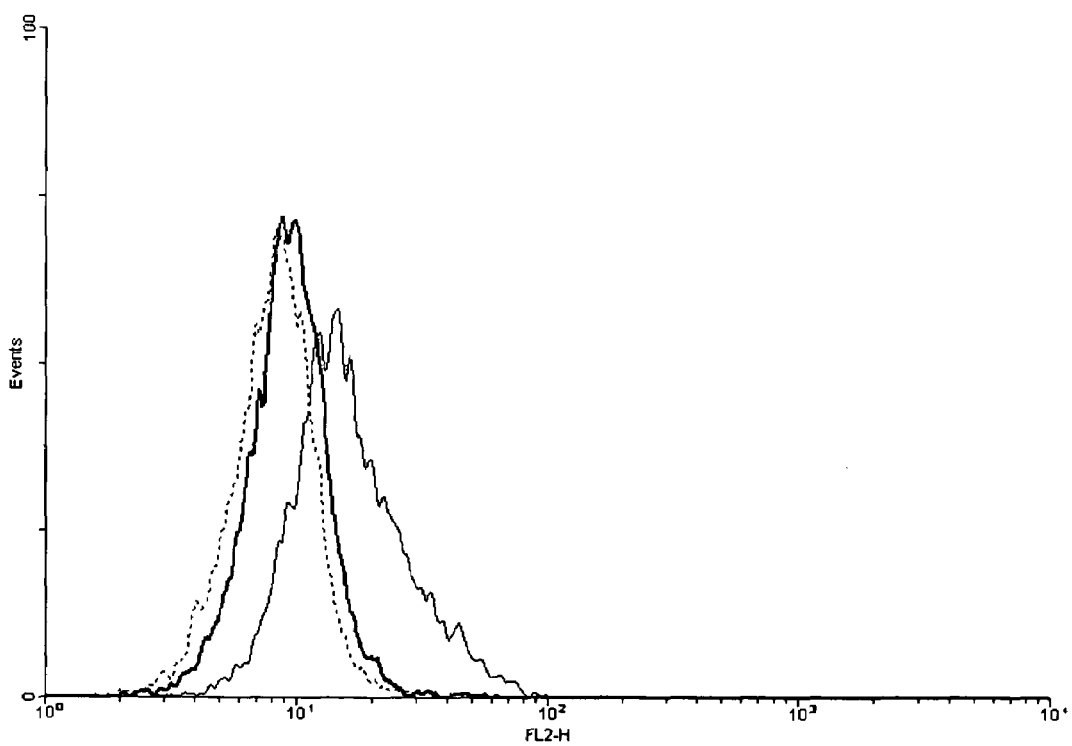
FIG. 15 shows the flow cytometric analysis of the binding of the S565 fragment of the S protein of SARS-CoV to Vero cells in the presence or absence of antibody 03-014. The dotted line indicates Vero cells incubated with a myc-tagged control protein, i.e., bivalent scFv 02-006. The normal line and bold line indicate Vero cells incubated with a myc-tagged S565 fragment in the absence or presence of antibody 03-014, respectively.
Figure 16:
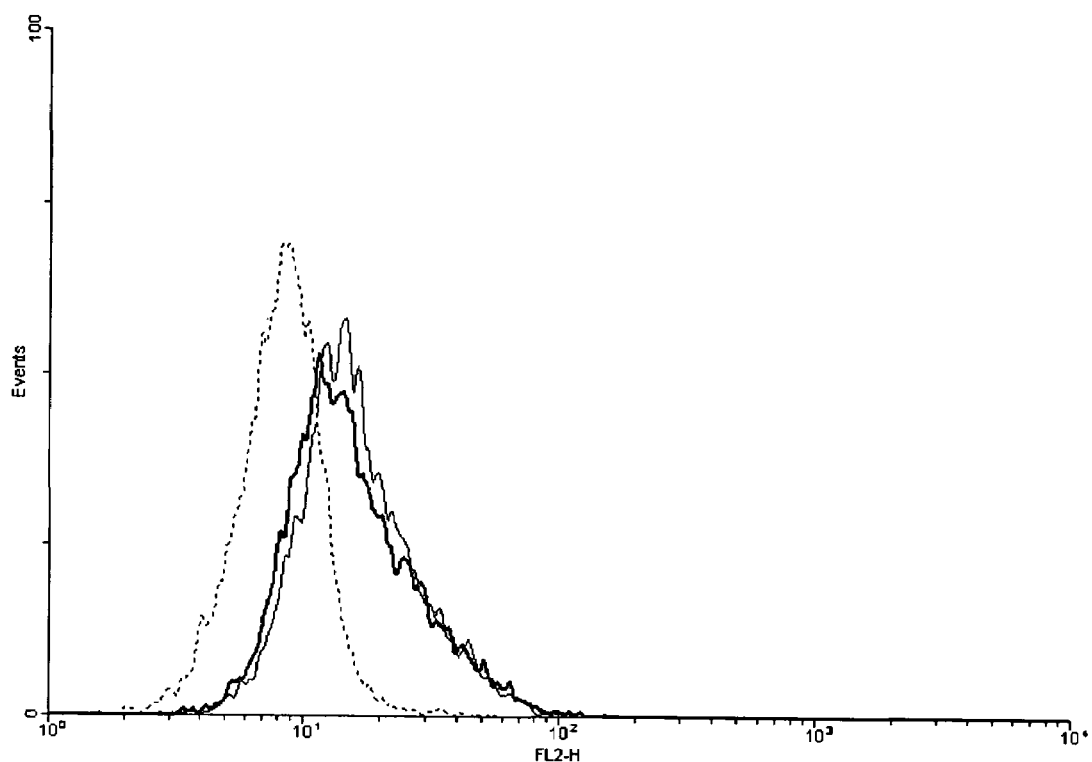
FIG. 16 shows the flow cytometric analysis of the binding of the S565 fragment of the S protein of SARS-CoV to Vero cells in the presence or absence of antibody 03-018. The dotted line indicates Vero cells incubated with a myc-tagged control protein, i.e., bivalent scFv 02-006. The normal line and bold line indicate Vero cells incubated with a myc-tagged S565 fragment in the absence or presence of antibody 03-018, respectively.
Figure 17:
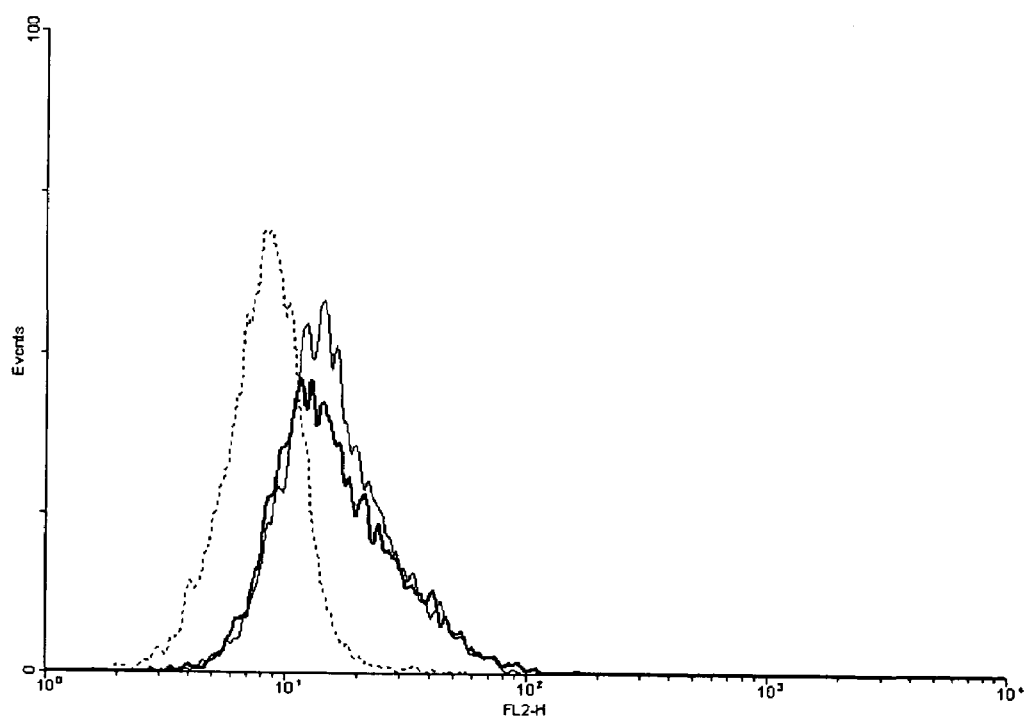
FIG. 17 shows the flow cytometric analysis of the binding of the S565 fragment of the S protein of SARS-CoV to Vero cells in the presence or absence of the control anti-EPCAM antibody 02-027. The dotted line indicates Vero cells incubated with a myc-tagged control protein, i.e., bivalent scFv 02-006. The normal line and bold line indicate Vero cells incubated with a myc-tagged S565 fragment in the absence or presence of antibody 02-027, respectively.

To further narrow the binding site of the antibodies, binding to a recombinant fragment comprising residues 318-510 of the S protein (S318-510) was evaluated. FIG. 12 shows that only 03-006, 03-013 and 03-014 were capable of binding the S318-510 fragment.

As shown in a titration experiment performed similarly as the titration experiment described above, antibody 03-014 appeared to bind S565 with a higher affinity than the antibodies 03-006 and 03-013 (see FIG. 13).

Using a similar set-up as described above, a competition ELISA was performed. Captured S565 was incubated with 1 μg/ml (nonsaturating) biotinylated antibody 03-014 without competing antibody or in the presence of a 25- or 50-fold excess of competing IgG (antibody 03-006 or 03-014). Bound biotinylated antibody 03-014 was detected with streptavidin-conjugated-HRP (BD Pharmingen) and developed as described above. The competition ELISA revealed that binding of antibody 03-014 was unaffected in the presence of a 25- or 50-fold excess of unlabeled 03-006 and it was concluded that their binding sites do not overlap (see FIG. 14).

Flow cytometry analysis was used to assay binding of the fragments of the S protein to angiotensin-converting enzyme 2 (ACE2), the natural receptor for SARS-CoV infectivity (Li et al., 2003). Vero cells expressing ACE2 (measured by means of a polyclonal anti-ACE2 antibody (R&D systems)) were incubated for one hour at 4° C. with saturating concentrations of the myc-tagged S565 fragment. As a control the Vero cells were incubated with a myc-tagged bivalent scFv 02-006. Alternatively, the S565 fragment was incubated with the IgG antibodies 03-014 (anti-SARS-CoV S protein antibody), 03-018 (anti-SARS-CoV N protein antibody) or 02-027 (anti-EPCAM control antibody) prior to incubation with the Vero cells. After three washes, bound fragment and the control protein were detected by flow cytometry analysis by using biotinylated anti-myc antibody (Santa Cruz Biotechnology Inc.) and streptavidin-conjugated phycoerythrin (Caltag). All incubations and washes were performed at 4° C. in PBS, supplemented with 0.5% bovine serum albumin (BSA). As shown in FIG. 15, preincubation of fragment S565 in the presence of 0.5 μM antibody 03-014 resulted in complete loss of S565 binding to Vero cells, whereas in the presence of antibody 0.5 μM antibody 03-018 (see FIG. 16) or 0.5 μM antibody 02-027 (see FIG. 17), S565 binding to Vero cells remained unaffected. In conclusion, monoclonal antibody 03-014 blocked binding of S565 to Vero cells, whereas the antibodies 03-018 and 02-027 did not. In an identical experiment it was shown that antibody 03-006 was capable of partially blocking binding of the S565 fragment to Vero cells (data not shown). Together, these data suggest that antibody 03-014 neutralizes SARS-CoV, by preventing the interaction of the S protein to cellular receptors such as ACE2.

Example 13

Construction of a ScFv Phage Display Library Using Peripheral Blood Lymphocytes of a Patient Having Been Exposed to SARS-CoV Lymphocytes were obtained from a patient recovered from SARS-CoV (see Rickerts et al. 2003) and frozen in liquid nitrogen. The lymphocytes were quickly thawed in a 37° C. water bath and transferred to wet-ice. The lymphocytes were diluted with cold DMEM culture medium to a final volume of 50 ml in a 50 ml tube and centrifuged for 5 minutes at 350×g. The obtained cell pellet was suspended in 5 ml DMEM and cell density was determined microscopically using trypan-blue exclusion to visualize dead cells. All cells (~5×$10^6$) were spun again for 5 minutes at 350×g, decanted and suspended in residual fluid (DMEM). Total RNA was prepared from these cells using organic phase separation (TRIZOL™) and subsequent ethanol precipitation. The obtained RNA was dissolved in DEPC treated ultrapure water and the concentration was determined by OD 260 nm measurement. Thereafter, the RNA was diluted to a concentration of 100 ng/μd. Next, 1 μg of RNA was converted into cDNA as follows: To 10 μl total RNA, 13 μl DEPC treated ultrapure water and 1 μl random hexamers (500 ng/µl) were added and the obtained mixture was heated at 65° C. for five minutes and quickly cooled on wet-ice. Then, 8 µl 5× First-Strand buffer, 2 µl dNTP (10 mM each), 2 µl DTT (0.1 M), 2 µl Rnase-inhibitor (40 U/µl) and 2 µl SUPERSCRIPT™ III MMLV reverse transcriptase (200 U/µl) were added to the mixture, incubated at room temperature for five minutes and incubated for one hour at 50° C. The reaction was terminated by heat inactivation, i.e., by incubating the mixture for 15 minutes at 75° C.

The obtained cDNA products were diluted to a final volume of 200 µl with DEPC treated ultrapure water. The OD260 nm of a 50 times diluted solution (in 10 mM Tris buffer) of the dilution of the obtained cDNA products gave a value of 0.1.

Figure 7:
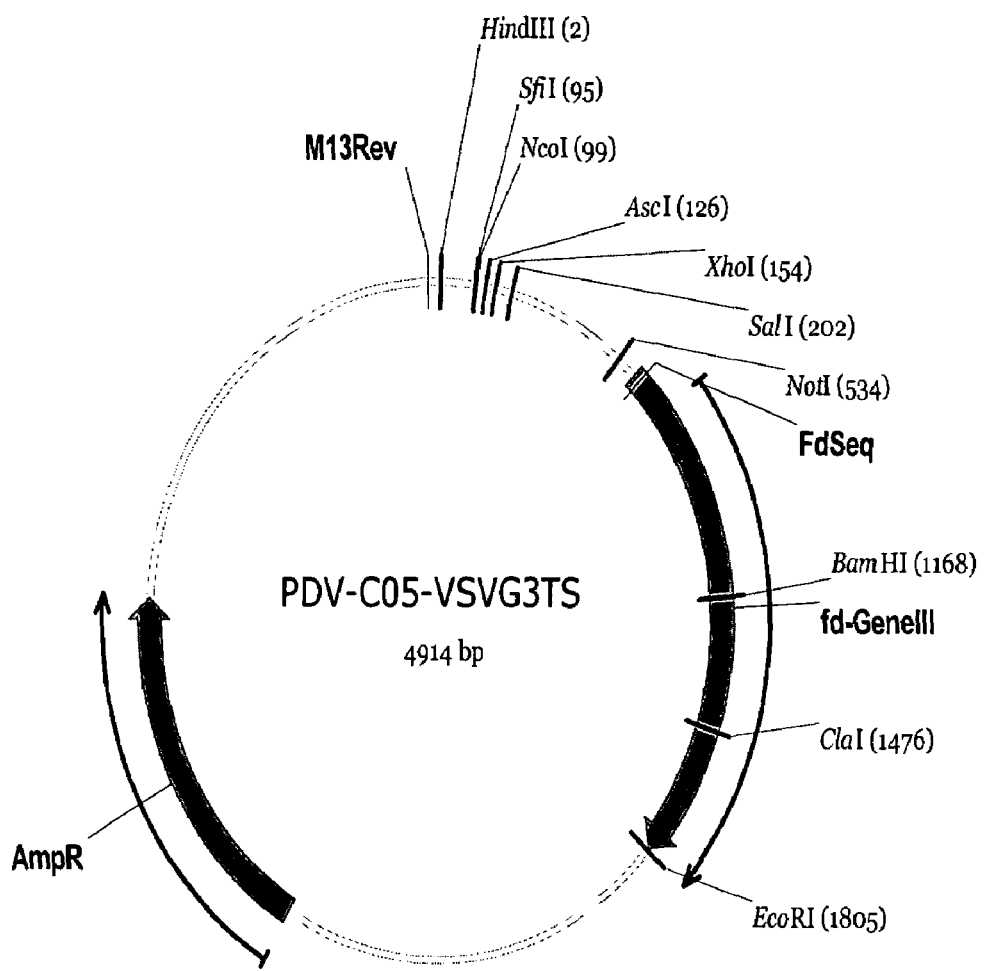
FIG. 7 shows the vector pDV-C05.

Five to 10 µl of the diluted cDNA products were used as template for PCR amplification of the immunoglobulin gamma heavy chain family and kappa or lambda light chain sequences using specific oligonucleotide primers (see Tables 8-15). PCR reaction mixtures contained, besides the diluted cDNA products, 25 pmol sense primer and 25 pmol anti-sense primer in a final volume of 50 µl of 20 mM Tris-HCl (pH 8.4), 50 mM KCl, 2.5 mM MgCl$_2$, 250 µM dNTPs and 1.25 units Taq polymerase. In a heated-lid thermal cycler having a temperature of 96° C., the mixtures obtained were quickly melted for two minutes, followed by 30 amplification cycles of: 30 seconds at 96° C., 30 seconds at 60° C. and 60 seconds at 72° C. In a first round amplification, each of nine sense directed primers (see Table 8; covering all families of heavy chain variable regions) was combined with an IgG specific constant region anti-sense primer called HuCIgG 5'-GTC CAC CTT GGT GTT GCT GGG CTT-3' (SEQ ID NO:131) yielding nine products of about 650 basepairs. These products were purified on a 2% agarose gel and isolated from the gel using QIAGEN™ gel-extraction columns. One-tenth of each of the isolated products was used in an identical PCR reaction as described above using the same nine sense primers (covering all families of heavy chain variable regions), whereby each sense primer was combined with one of the four J-region specific anti-sense primers (see Table 9). This resulted in 36 products of approximately 350 basepairs. The products obtained were purified on a 2% agarose gel and isolated from the gel using QIAGEN™ gel-extraction columns. In a third round, 1/10 of each of the isolated products was subjected to re-amplification with the same set of primers as in the second round with the proviso that the primers used were extended with restriction sites (see Table 10) to enable directed cloning in the phage display vector pDV-C05 (see FIG. 7 and SEQ ID NO:130). This resulted again in 36 products. These products were pooled per used (VH) sense primer into nine fractions. In the next step, 2.5 µg of pooled fraction and 100 µg pDV-C05 vector were digested with NcoI and XhoI and purified by gel. Thereafter, a ligation was performed overnight at 16° C. as follows. To 500 ng pDV-C05 vector 70 ng pooled fraction was added in a total volume of 50 µl ligation mix containing 50 mM Tris-HCl (pH 7.5), 10 mM MgCl$_2$, 10 mM DTT, 1 mM ATP, 25 µg/ml BSA and 2.5 µl T4 DNA Ligase (400 u/µl). This procedure was followed for each pooled fraction. The ligation mixes were purified by phenol/chloroform, followed by a chloroform extraction and ethanol precipitation, methods well known to the skilled artisan. The DNA obtained was dissolved in 50 µl ultrapure water and per ligation mix two times 2.5 µl aliquots were electroporated into 40 µl of TG1 competent *E. coli* bacteria according to the manufacturer's protocol (Stratagene). Transformants were grown overnight at 37° C. in a total of 27 dishes (three dishes per pooled fraction; dimension of dish: 240 mm×240 mm) containing 2TY agar supplemented with 50 µg/ml ampicillin and 4.5% glucose. A (sub)library of variable heavy chain regions was obtained by scraping the transformants from the agar plates. This (sub)library was directly used for plasmid DNA preparation using a QIAGEN™ kit.

The light chain immunoglobulin sequences were amplified from the same cDNA preparation in a similar three round PCR procedure and identical reaction parameters as described above for the heavy chain regions with the proviso that the primers depicted in Tables 11 to 15 were used. The first amplification was performed using a set of seventeen light chain variable region sense primers (eleven for the lambda light chain (see Table 11) and six for the kappa light chain (see Table 12)) each combined with an anti-sense primer recognizing the C-kappa called HuCk 5'-ACACTCTCCCCTGTTGAAGCT CTT-3' (see SEQ ID NO:158) or C-lambda constant region HuCλ2 5'-TGAACAT-TCTGTAGGGGCCACTG-3' (see SEQ ID NO:159) or HuCλ7 5'-AGAGCATTCTGCAGGGGCCACTG-3' (see SEQ ID NO:160) (the HuCλ2 and HuCλ7 anti-sense primers were mixed to equimolarity before use), yielding 17 products of about 600 basepairs. These products were purified on a 2% agarose gel and isolated from the gel using QIAGEN™ gel-extraction columns. One-tenth of each of the isolated products was used in an identical PCR reaction as described above using the same seventeen sense primers, whereby each lambda light chain sense primer was combined with one of the three Jlambda-region specific anti-sense primers (see Table 13) and each kappa light chain sense primer was combined with one of the five Jkappa-region specific anti-sense primers (see Table 14). This resulted in 63 products of approximately 350 basepairs. The products obtained were purified on a 2% agarose gel and isolated from the gel using QIAGEN™ gel-extraction columns. In a third round, 1/10 of each of the isolated products was subjected to re-amplification with the same set of primers as in the second round with the proviso that the primers used were extended with restriction sites (see Table 15) to enable directed cloning in the heavy chain (sub)library vector. This resulted again in 63 products. These products were pooled to a total of ten fractions. This number of fractions was chosen to maintain the natural distribution of the different light chain families within the library and to over or under represent certain families. The number of alleles within a family was used to determine the percentage of representation within a library (see Table 16). Next, the fractions were digested with SalI and NotI and ligated in the heavy chain (sub)library vector, which was cut with the same restriction enzymes, using the same ligation procedure and volumes as described above for the heavy chain (sub)library. Ligation purification and subsequent transformation of the resulting definitive library was also performed as described above for the heavy chain (sub)library. The transformants were grown in 30 dishes (three dishes per pooled fraction; dimension of dish: 240 mm×240 mm) containing 2TY agar supplemented with 50 µg/ml ampicillin and 4.5% glucose. All bacteria were harvested in 2TY culture medium containing 50 µg/ml ampicillin and 4.5% glucose, mixed with glycerol to 15% (v/v) and frozen in 1.5 ml aliquots at −80° C. Rescue and selection of the library were performed as described supra for the non-immune libraries.

Additionally, a naïve phage display library of scFvs was prepared. For that purpose, healthy donor peripheral blood lymphocytes were used as source of immuno globulin transcripts. Using the protocols described above, immunoglobulin gamma VH regions were amplified and cloned into a PDV-C05 vector already containing a VkIII light chain fragment. This resulted in a non-immunized, naïve library expressing scFv with a fixed VkIII light chain variable region and having a size of approximately 10×10⁶.

Example 14

Selection of Phage Carrying Single Chain Fv Fragments Specifically Recognizing SARS-CoV from Naïve and Immune Phage Display Libraries Antibody fragments were selected essentially as described previously (see Example 1). For the selections described below an UV-inactivated SARS-CoV preparation was used (for preparation thereof see Example 9). In contrast to the selections described in Example 1, no pre-subtraction using heat-inactivated fetal bovine serum coated MAXISORP™ tubes (Nunc) was performed. To the SARS-CoV coated tubes, 500 µl (approximately 10¹³ cfu) of a naïve or an immune phage display library expressing single chain Fv fragments (scFvs) (see Example 13 for the construction of these libraries), one volume of 4% PBS-FM and Tween-20 to a final concentration of 0.05% was added.

For the naïve phage display library selections, binding was allowed to proceed for 1 hour on a slowly rotating wheel at 37° C. followed by an incubation of 30 minutes without agitation. The tubes were emptied and washed as follows: first round, ten times with PBS containing 0.05% Tween-20 (PBST) and ten times with PBS; second round, 15 times with PBST and ten times with PBS; third round 15 times with PBST and 15 times with PBS.

For the immune phage display library selections which consisted of a single round only, binding was allowed to proceed at 37° C. or room temperature as described above. The following selections and washes were performed: incubation at 37° C., washing five times with PBST and five times with PBS; incubation at 37° C., washing ten times with PBST and ten times with PBS; incubation at room temperature, washing ten times with PBST and ten times with PBS. Bound phages were eluted and processed as described in Example 1. Phages derived from individual colonies were tested in ELISA for binding activity to SARS-CoV coated to 96-well plates.

In the selections from the naïve phage display library the phage antibodies called SC03-019 and SC03-059 were obtained. In the selections from the immune phage display library the phage antibodies called SC03-020, SC03-021, SC03-022, SC03-023, SC03-024, SC03-025, SC03-026, SC03-027, SC03-029, SC03-030, SC03-031, SC03-032, SC03-033, SC03-034, SC03-035, SC03-036, SC03-037, SC03-038, SC03-039, SC03-040, SC03-041, SC03-042, SC03-043, SC03-044, SC03-045, SC03-046, SC03-047, SC03-048, SC03-049, SC03-050, SC03-051, SC03-052, SC03-053, SC03-054, SC03-055, SC03-056, SC03-057 and SC03-058 were obtained.

Example 15

Validation of the SARS-CoV Specific Single-Chain Phage Antibodies Derived from the Naïve and Immune Phage Display Library Selected single-chain phage antibodies that were obtained in the screens described in Example 14 were validated in ELISA for specificity, i.e., binding to the SARS-CoV preparation mentioned in Example 14, essentially as described in Example 2. In contrast to Example 2, the single-chain phage antibodies were not tested for binding to 10% FBS.

As shown in Table 17, the selected phage antibodies called SC03-019, SC03-020, SC03-021, SC03-022, SC03-023, SC03-024, SC03-025, SC03-026, SC03-027, SC03-029, SC03-030, SC03-031, SC03-032, SC03-033, SC03-034, SC03-035, SC03-036, SC03-037, SC03-038, SC03-039, SC03-040, SC03-041, SC03-042, SC03-043, SC03-044, SC03-045, SC03-046, SC03-047, SC03-048, SC03-049, SC03-050, SC03-051, SC03-052, SC03-053, SC03-054, SC03-055, SC03-056, SC03-057, SC03-058 and SC03-059 displayed significant binding to the immobilized SARS-CoV preparation. As a control, the procedure was performed simultaneously using no single-chain phage antibody.

Example 16

Characterization of the scFvs Specific for SARS-CoV Derived from the Naïve and Immune Phage Display Library From the selected specific single chain phage antibody (scFv) clones (see Example 14) plasmid DNA was obtained and nucleotide sequences were determined according to standard techniques. The nucleotide sequences of the scFvs (including restriction sites for cloning) called SC03-019, SC03-020, SC03-021, SC03-022, SC03-023, SC03-024, SC03-025, SC03-026, SC03-027, SC03-029, SC03-030, SC03-031, SC03-032, SC03-033, SC03-034, SC03-035, SC03-036, SC03-037, SC03-038, SC03-039, SC03-040, SC03-041, SC03-042, SC03-043, SC03-044, SC03-045, SC03-046, SC03-047, SC03-048, SC03-049, SC03-050, SC03-051, SC03-052, SC03-053, SC03-054, SC03-055, SC03-056, SC03-057, SC03-058 and SC03-059 are shown in SEQ ID NO:211, SEQ ID NO:213, SEQ ID NO:215, SEQ ID NO:217, SEQ ID NO:219, SEQ ID NO:221, SEQ ID NO:223, SEQ ID NO:225, SEQ ID NO:227, SEQ ID NO:229, SEQ ID NO:231, SEQ ID NO:233, SEQ ID NO:235, SEQ ID NO:237, SEQ ID NO:239, SEQ ID NO:241, SEQ ID NO:243, SEQ ID NO:245, SEQ ID NO:247, SEQ ID NO:249, SEQ ID NO:251, SEQ ID NO:253, SEQ ID NO:255, SEQ ID NO:257, SEQ ID NO:259, SEQ ID NO:261, SEQ ID NO:263, SEQ ID NO:265, SEQ ID NO:267, SEQ ID NO:269, SEQ ID NO:271, SEQ ID NO:273, SEQ ID NO:275, SEQ ID NO:277, SEQ ID NO:279, SEQ ID NO:281, SEQ ID NO:283, SEQ ID NO:285, SEQ ID NO:287 and SEQ ID NO:289, respectively.

The amino acid sequences of the scFvs called SC03-019, SC03-020, SC03-021, SC03-022, SC03-023, SC03-024, SC03-025, SC03-026, SC03-027, SC03-029, SC03-030, SC03-031, SC03-032, SC03-033, SC03-034, SC03-035, SC03-036, SC03-037, SC03-038, SC03-039, SC03-040, SC03-041, SC03-042, SC03-043, SC03-044, SC03-045, SC03-046, SC03-047, SC03-048, SC03-049, SC03-050, SC03-051, SC03-052, SC03-053, SC03-054, SC03-055, SC03-056, SC03-057, SC03-058 and SC03-059 are shown in SEQ ID NO:212, SEQ ID NO:214, SEQ ID NO:216, SEQ ID NO:218, SEQ ID NO:220, SEQ ID NO:222, SEQ ID NO:224, SEQ ID NO:226, SEQ ID NO:228, SEQ ID NO:230, SEQ ID NO:232, SEQ ID NO:234, SEQ ID NO:236, SEQ ID NO:238, SEQ ID NO:240, SEQ ID NO:242, SEQ ID NO:244, SEQ ID NO:246, SEQ ID NO:248, SEQ ID NO:250, SEQ ID NO:252, SEQ ID NO:254, SEQ ID NO:256, SEQ ID NO:258, SEQ ID NO:260, SEQ ID NO:262, SEQ ID NO:264, SEQ ID NO:266, SEQ ID NO:268, SEQ ID NO:270, SEQ ID NO:272, SEQ ID NO:274, SEQ ID NO:276, SEQ ID NO:278, SEQ ID NO:280, SEQ ID NO:282, SEQ ID NO:284, SEQ ID NO:286, SEQ ID NO:288 and SEQ ID NO:290, respectively.

The VH and VL gene identity (see I. M. Tomlinson, S. C. Williams, O. Ignatovitch, S. J. Corbett, G. Winter, V-BASE Sequence Directory, Cambridge United Kingdom: MRC Centre for Protein Engineering (1997)) and heavy chain CDR3 compositions of the scFvs specifically binding the SARS-CoV preparation are depicted in Table 18.

Example 17

In Vivo Experiment in Ferrets with Recombinant Human anti-SARS-CoV Antibodies Having Neutralizing Activity The experiment was performed to investigate the neutralizing capacity of the anti-SARS-CoV monoclonal antibodies of the invention in vivo essentially as described by Emini et al. (1990). Briefly, the human monoclonal anti-SARS-CoV antibody 03-014 and the control anti-Epcam antibody 02-027 were pre-incubated in vitro with two different titers ($10^3$ and $10^4$ $TCID_{50}$) of the SARS-CoV strain SCV-P4 (5688) (obtained from patient 5688, see above). Antibody concentrations used were extrapolated from the concentration of antibody needed to neutralize 100$TCID_{50}$ of virus in a volume of 100 µl (i.e., 6.25 µg/ml; see in vitro neutralization data in Example 7) and multiplied by twenty (i.e., 0.13 mg/ml for 1000$TCID_{50}$, 1.3 mg/ml for 10,000$TCID_{50}$). The virus/antibody mixtures obtained were used to infect ferrets via the intratracheal route (Fouchier et al. 2003). Cell cultures of Vero 118 cells were inoculated in parallel to verify the in vitro neutralizing activity of the monoclonal antibody 03-014 and the expected infectivity of the virus in case of pre-incubation with the control antibody. Ferrets were monitored for signs of disease and shedding of virus (RT-PCR) and ultimately sacrificed and examined by histopathology.

High dose and low dose solutions of the monoclonal antibody 03-014 and the control antibody were prepared as follows. The working solution of the monoclonal antibody 03-014 had a concentration of 1.44 mg/ml. 4.87 ml of this working solution was brought into a 15 ml tube (high dose solution, 1.44 mg/ml final concentration). To obtain the low dose solution, 541 µl of the working solution was added to 2.46 ml PBS (low dose solution, 0.26 mg/ml final concentration) and mixed well. 2.7 ml of this low dose solution was brought into a 15 ml tube.

The starting solution of the control antibody had a concentration of 3.90 mg/ml. 2.10 ml of this starting solution was added to 3.58 ml PBS to obtain a working solution with a final concentration of 1.44 mg/ml. 4.87 ml of this working solution was brought into a 15 ml tube (high dose solution, 1.44 mg/ml final concentration). To obtain the low dose solution, 541 µl of the working solution was added to 2.46 ml PBS (low dose solution, 0.26 mg/ml final concentration) and mixed well. 2.7 ml of this low dose solution was brought into a 15 ml tube.

After preparation of the high dose and low dose solutions of the monoclonal antibodies, the high dose and low dose solution of the SARS-CoV were prepared. The starting solution of the SARS-CoV had a concentration of $10^7$ $TCID_{50}$/ml. The starting solution was thawed at 37° C. and 100 µl of this solution was added to 900 µl PBS and mixed well. The working solution thus obtained had a concentration of $10^6$ $TCID_{50}$/ml.

To obtain a high dose SARS-CoV solution 200 µl working solution was added to 1.8 ml PBS and mixed well (high dose SARS-CoV solution, 100,000 $TCID_{50}$/ml). To obtain a low dose SARS-CoV solution 200 µl high dose solution was added to 1.8 ml PBS and mixed well. After that, the thus obtained diluted high dose solution was further diluted by adding 1.2 ml of this diluted high dose solution to 4.8 ml PBS and mixing (low dose SARS-CoV solution, 2,000 $TCID_{50}$/ml).

Next, the high dose and low dose solutions of the monoclonal antibodies were mixed with the high and low dose SARS-CoV solutions at 37° C. for one hour. The following groups were prepared.

Group 1: 2.7 ml low dose SARS-CoV solution was added to 2.7 ml low dose solution of the monoclonal antibody 03-014 and mixed well (final concentration of SARS-CoV was 1,000 $TCID_{50}$/ml; final concentration of monoclonal antibody 03-014 0.13 mg/ml; total volume 5.4 ml).

Group 2: 0.54 ml high dose SARS-CoV solution was added to 4.87 ml high dose solution of the monoclonal antibody 03-014 and mixed well (final concentration of SARS-CoV was 10,000 $TCID_{50}$/ml; final concentration of monoclonal antibody 03-014 1.3 mg/ml; total volume 5.4 ml).

Group 3: 2.7 ml low dose SARS-CoV solution was added to 2.7 ml low dose solution of the monoclonal control antibody and mixed well (final concentration of SARS-CoV was 1,000 $TCID_{50}$/ml; final concentration of monoclonal control antibody 0.13 mg/ml; total volume 5.4 ml).

Group 4: 0.54 ml high dose SARS-CoV solution was added to 4.87 ml high dose solution of the monoclonal control antibody and mixed well (final concentration of SARS-CoV was 10,000 $TCID_{50}$/ml; final concentration of monoclonal control antibody 1.3 mg/ml; total volume 5.4 ml).

1.1 ml of the solution of each of the four groups was removed for inoculation of Vero 118 cell cultures. One ml of the solution of each of the four groups was added to a separate well of substrate plates (each plate containing six wells). Each well contained an 80% monolayer of Vero 118 cells. The monolayers were prepared by trypsinizing Vero 118 cells, diluting them in DMEM with 5% FBS, seeding 2*$10^6$ Vero 118 cells per separate well and incubating the cells for 16 to 20 hours at 37° C. with 2 ml DMEM containing sodium bicarbonate 0.75%, L-glutamine 2 mM and penicillin/streptomycin (10 U/ml). The plates with the above solutions were incubated overnight at 37° C. The medium was replaced by fresh medium and the plates were incubated for a further three to five days at 37° C. and monitored for CPE.

To each of the remaining amounts (4.3 ml) of each of the four groups 8.6 ml PBS was added. Prior to any handling or sampling, the animals were anesthetized by means of light ketamine (2.5 mg/kg) and domitor (0.1 ml/kg), followed by antisedan (0.05 ml/kg). Before inoculation, from each ferret a nasal swab was taken (day 0). Each ferret was intratracheally inoculated with 3 ml of the respective solutions as indicated in the scheme shown in Table 19. Nasal swabs alone were taken from each ferret as indicated in the scheme shown in Table 19 (day 2). Animals were checked every day for clinical symptoms such as respiratory problems, erythema and lethargy. Animals were weighed every other day. From each ferret nasal and pharyngeal swabs were taken as indicated in the scheme shown in Table 19 (day 4 or 7). Swabs were preserved in standard virus transport medium and stored at −80° C. Ferrets were euthanized by means of total exsanguination under full anesthesia by means of ketamine (5 mg/kg) and domitor (0.1 ml/kg) as indicated in the scheme shown in Table 19 (day 4 or 7). Next, the samples were analyzed by RT-PCR with primers and probes specific for the nucleoprotein (NP) gene of SARS-CoV to quantify SARS-CoV in lung tissues as described in Kuiken et al. 2003.

Figure 18:
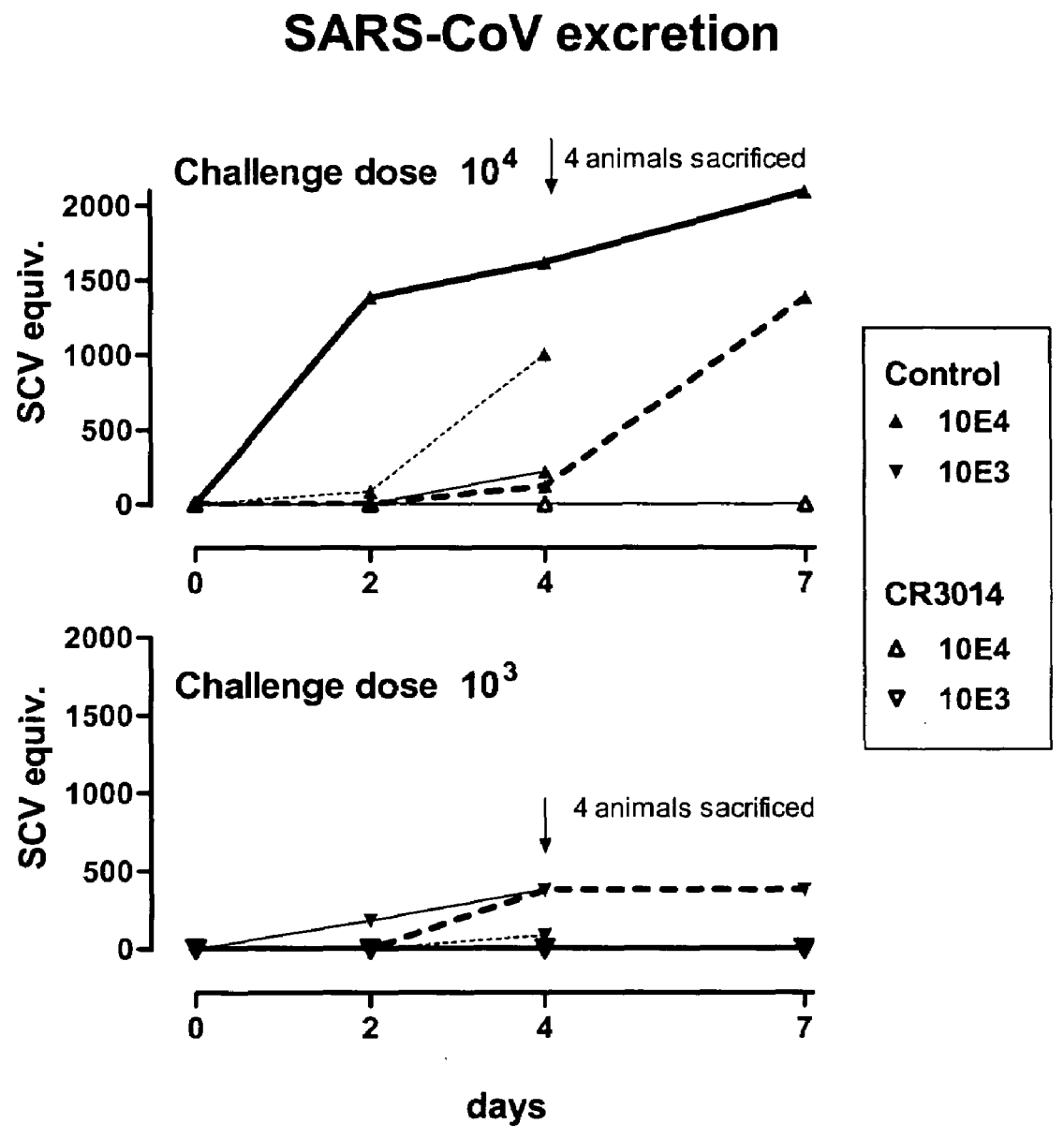

As shown in FIG. 18, ferrets inoculated with the virus-control antibody mixture displayed dose-dependent SARS-CoV excretion at two, four and seven days after inoculum administration. In contrast, in the animals inoculated with the virus-03-014 antibody mixture no SARS-CoV could be detected at any time point, indicating that no virus had disseminated from the site of inoculation.

SARS-CoV titers in the lung were obtained using an in vitro virus titration assay. Lung samples were collected and weighed and transferred to a 5 ml tubes containing 1 ml RPMI1640 medium. The samples were transferred to ice, homogenized and cellular debris was pelleted by centrifugation. From the supernatant ten-fold serial dilutions were prepared starting with a dilution of 1:10. 100 µl of the homogenate dilutions were added to 80% confluent monolayers of Vero 118 cells in a 96-well plate. The cells were incubated for five days and the occurrence cytopathogenic effect (CPE) was scored. SARS-CoV lung titers were expressed as TCID50/ml and were calculated according to the Reed and Muench method.

As shown in FIG. 19, ferrets inoculated with the virus-control antibody mixture displayed equal high SARS-CoV titers (10E6.5/ml lung homogenate) at day 4 independent of the virus challenge dose. At day 7, the virus load in the lungs of both control groups was significantly lower (10E4/ml lung homogenate), suggesting that the animals are capable of clearing the virus. Strikingly, very low amounts of SARS-CoV were detected in both the high and low dose groups inoculated with the virus-03-014 antibody mixture (10E1.5/ml lung homogenate is the detection limit of the assay used).

The analysis of the pathology in the ferret lungs was performed according to the following procedure. Necropsies were done according to a standard protocol; one lung of each ferret was inflated with 10% neutral-buffered formalin by intrabronchial intubation and suspended in 10% neutral-buffered formalin overnight. Samples were collected in a standard manner (one from the cranial part of the lung, one from the medial and two from the caudal part), embedded in paraffin, cut at 5 µm and stained with hematoxylin and eosin (HE). For semi-quantitative assessment of SARS-CoV-infection-associated inflammation in the lung, each HE-stained section was examined for inflammatory foci by light microscopy using a 2.5× objective. If any suspect lesions were seen, they were examined at higher power to determine whether typical characteristics are present (intra-alveolar oedema, neutrophils and macrophages in alveolar lumina, type 2 pneumocyte hyperplasia). Lung sections were scored as followed: -, no SARS lesions; +, mild SARS lesions; ++, moderate SARS lesions; +++, marked SARS lesions. The final score for each animal is the cumulative score of two lung sections. Sections were examined in a blinded manner.

As shown in FIG. 20, ferrets inoculated with the virus-control antibody mixture displayed significant lung pathology at day 4 independent of the virus challenge dose. At day 7, the pathological signs in the lungs of the low dose control group had disappeared, demonstrating that these animals had the capacity to recover from the disease. In both high and low dose groups inoculated with the virus-03-014 antibody mixture no signs of pathology were observed at both four and seven days post treatment indicating that the very low amount of virus present in the lungs did not induce tissue damage.

Example 18

Efficacy of the Human anti-SARS-CoV Monoclonal Antibodies Upon Passive Transfer and SARS-CoV Challenge in Ferrets To address whether the human anti-SARS-CoV monoclonal antibodies can be efficacious in a prophylactic setting a SARS-CoV challenge experiment has been performed in ferrets. One day prior to the SARS-CoV challenge ferrets were administered 10 mg/kg of monoclonal 03-014-IgG1 antibody intraperitoneally (i.p.). Prior to all experimental procedures the animals were anesthetized as described supra. Two groups of four animals were treated with either a human monoclonal control IgG1 antibody (02-027, anti-Epcam antibody) or with the monoclonal anti-SARS-CoV 03-014 IgG1 antibody. The anti-SARS-CoV 03-014 antibody (concentration 1.23 mg/ml) was used undiluted for i.p. administration. The 02-027 control IgG1 antibody (concentration 3.9 mg/ml) was diluted 1:2 in PBS to achieve a final concentration of 1.3 mg/ml. The volume needed for the injection of the 10 mg/kg dose was based on the weight of the individual ferrets and varied between 6.5 and 8 ml. The antibodies were injected at ambient temperature. Prior to the antibody transfer and prior to the SARS-CoV challenge, serum samples were obtained from each animal to assess the SARS-CoV neutralization titer as described before. All animals were challenged with $10^4$ TCID50 of the SARS-CoV strain SCV-P4 (5688). To this purpose the 5866 SARS-CoV virus stock (concentration: $10^7$ TCID50/ml) was thawed and 100 µl of the virus stock was added to 900 µl PBS (at room temperature) to obtain a working virus stock of $10^6$ TCID50/ml. To obtain the final solution containing the challenge dose of $10^4$ TCID50 per 3 ml challenge dose, 100 µl virus working stock was added to 30 ml PBS (at room temperature). Each ferret was inoculated intratracheally with 3 ml of virus mixture as described supra. Serum, pharyngeal swab and tissue samples were obtained according to Table 20. SARS-CoV excretion in pharyngeal swabs, SARS-CoV titers in lung tissue and lung pathology were analyzed as described supra.

Figure 21:
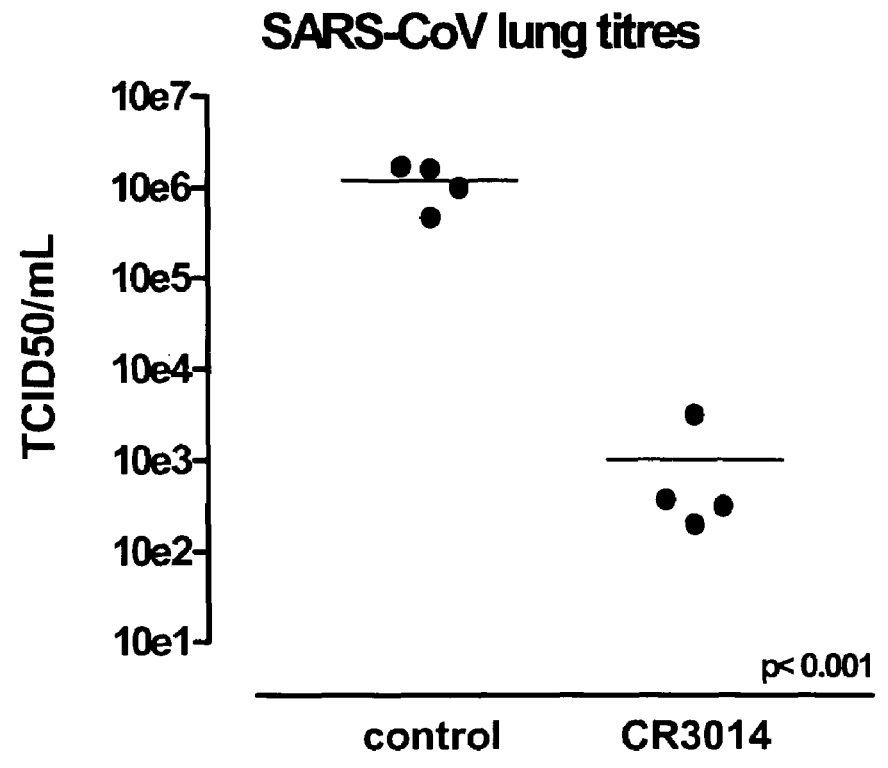

FIG. 21 shows that all control animals had high pulmonary SCV titers with a mean TCID50 in lung homogenates of 6.0 logs (SD 0.3), as compared to 2.7 logs (SD 0.5) in the 03-014 group, i.e., a difference in TCID50 of 3.3 logs (95% CI: 2.5-4.1 logs; p<=0.001). The data were compared using the Students's T-test, differences were considered significant at p-value less than 0.05.

Figure 22:
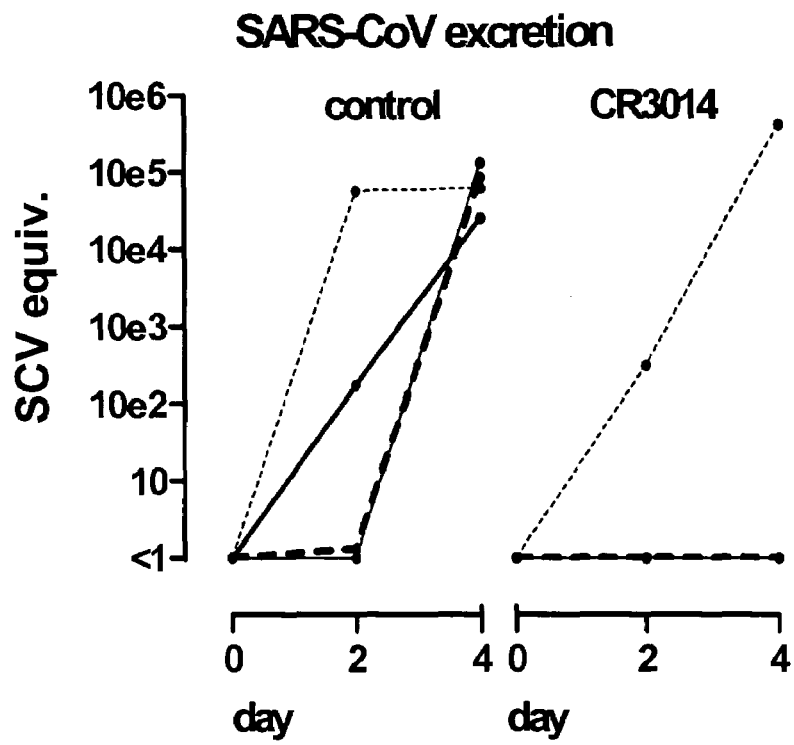
FIG. 22 shows SARS-CoV excretion measured by RT/PCR in nasopharyngeal swabs on days 2 and 4, expressed as SARS-CoV genome equivalents. In the 03-014-treated group (named CR3014) three animals had no SARS-CoV excretion and are superimposed.

In the control group, shedding of SARS-CoV in the throat was apparent two and four days after challenge. By contrast, pharyngeal excretion was completely abolished in three of the 03-014-treated animals (see FIG. 22). However, in one animal SARS-CoV excretion was comparable to the levels observed in the control group. Determination of the human IgG1 serum level of this ferret prior to challenge, revealed that this animal had acquired a 03-014 serum concentration below 5 µg/ml, whereas in the other three animals serum IgG1 levels ranged from 65-84 µg/ml, suggesting inappropriate antibody administration. This finding was considered an artifact of the intraperitoneal antibody application procedure. In agreement with this, a declined serum neutralizing titer could be demonstrated in this animal compared to the three animals that did not display pharyngeal SARS-CoV excretion. Neutralizing serum titers in this animal were less than half of those in the other animals on day 0 (titer of 5 against 100 TCID50), and were not detectable on day 2 after injection, compared with a titer of 5 to 10 against 100 TCID50 in the other animals on day 2.

Importantly, the differences in both pharyngeal and pulmonary viral titers between the control group and the 03-014 group were accompanied by a complete protection from macroscopic lung pathology in the group treated with 03-014 compared to the control group, who all showed multifocal lesions (p=0.029). Upon microscopic analysis, these lesions showed alveolar changes resembling diffuse alveolar damage as well as peribronchial, peribrochiolar, and perivascular lymphocytic cuffing.

Taken together, these results demonstrate that passive transfer of the 03-014 anti-SARS-CoV antibody was able to abolish SARS-CoV induced pulmonary lesions as well as SARS-CoV excretion in animals that had obtained sufficient 03-014 IgG serum titers (see Ter Meulen et al. 2004).

Example 19

Characterization of Anti-SARS-CoV IgG Antibodies by Electron Microscopy

Supernatants of SARS-CoV producing Vero cells were harvested 24 hours p.i. and used directly for indirect, two-step immuno-gold-labeling. SARS-CoV was adsorbed to carbon- and Pioloform-coated copper grids. After two washing steps with blocking buffer (PBS comprising 0.1% bovine serum albumin), the grids were incubated with the human monoclonal control IgG1 antibody (02-027, anti-Epcam antibody) or with the monoclonal anti-SARS-CoV 03-014 IgG1 antibody by floating on respective droplets for 30 minutes at room temperature. Next, surplus antibody was removed using a strip of filter paper and two washing steps on blocking buffer. Bound monoclonal antibodies were detected by incubation on droplets of anti-hu-IgG-gold-5 nm conjugates (British Biocell Corp). The grids were negative contrasted with 1% uranyl acetate and evaluated at a ZEISS EM 10 A transmission electron microscope.

Figure 23:
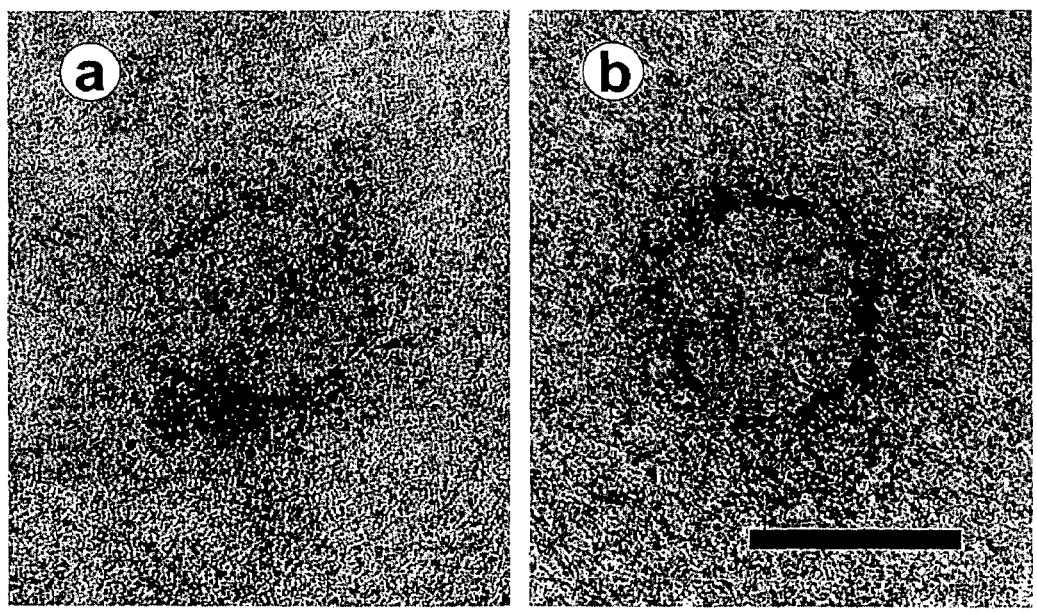
FIG. 23 shows electron micrographs of SARS-CoV incubated with the monoclonal anti-SARS-CoV 03-014 IgG1 antibody (see section a) or a human monoclonal control IgG1 antibody (see section b). The bar is 100 nm.

Incubation with the monoclonal anti-SARS-CoV 03-014 IgG1 antibody lead to a dense gold-label of the outer peplomer region of the SARS-CoV (see FIG. 23, section a), while incubation with the human monoclonal control IgG1 antibody did not induce any label (see FIG. 23, section b).

Figure 24A:
FIG. 24A: unstained (control) sections.
Figure 24B:
FIG. 24B: sections stained with the human monoclonal control IgG1 antibody 02-027 (anti-Epcam antibody)
Figure 24C:
FIG. 24C: sections stained with the monoclonal anti-SARS-CoV IgG1 antibody 03-009.
Figure 24D:
FIG. 24D: sections stained with the monoclonal anti-SARS-CoV IgG1 antibody 03-018.

In a similar way, ultra-thin sections of Vero cells infected with SARS-CoV were analyzed by electron microscopy. In FIG. 24A unstained ultra-thin sections of Vero cells infected with SARS-CoV are shown. In FIG. 24B the sections were stained with the human monoclonal control IgG1 antibody (02-027, anti-Epcam antibody), while in FIGS. 24C and 24D the sections were stained with the monoclonal anti-SARS-CoV IgG1 antibodies 03-009 and 03-018, respectively. The localization of the gold label clearly indicates that the nucleocapsid protein is retained within the virion.

Example 20

Construction and Evaluation of Binding of the Monoclonal Anti-SARS-CoV Antibodies to Variant S318-510 Fragments The diversity within the region 318-510 of the S protein was determined as follows. A list containing more than 146 genomes or genes encoding complete human SARS-CoV or fragments thereof was compiled. In 114 cases, an open reading frame encoding for full-length spike (S) protein was identified. Alignment of the spike amino acid residues 318-510 revealed 30 spike proteins, in which the region 318-510 was not identical to that of the spike protein of strain Frankfurt 1 (see Genbank accession number AY291315), which was used herein. The mutations, strains and Genbank numbers are depicted in Table 21. To investigate if 03-014 bound the S protein of all currently known human SARS-CoV isolates, eight recombinant spike fragments harboring the different amino acid substitutions as shown in Table 21 were generated. To this end, the above substitutions were introduced in the pHAVT20/myc-His A S318-510 vector using the Stratagene's QuikChange II site-directed mutagenesis kit according to the manufacturer's instructions. In case a sequence contained multiple amino acid substitutions, the process of mutagenesis, sequence analysis and confirmation was repeated for every single substitution. To rule out the introduction of additional mutations in the plasmid outside the gene of interest, the mutated (592 bp EcoRI-XbaI) fragment was recloned in EcoRI-XbaI cut pHAVT20/myc-His A. The resulting plasmids were transfected into 293T cells, and binding of 03-014 was evaluated by means of ELISA as described in Example 12. In addition, binding of HRP-conjugated monoclonal anti-His6 antibody (Roche) to each mutant was evaluated essentially as described above. Binding of anti-His6 and 03-014 to the wild-type S318-510 fragment derived from the Frankfurt 1 strain was set at 100%. Binding of the monoclonal anti-His6 antibody and 03-014 to the mutated S318-510 fragments was expressed as percentage of binding compared to the wild-type S318-510 fragment.

Figure 25:
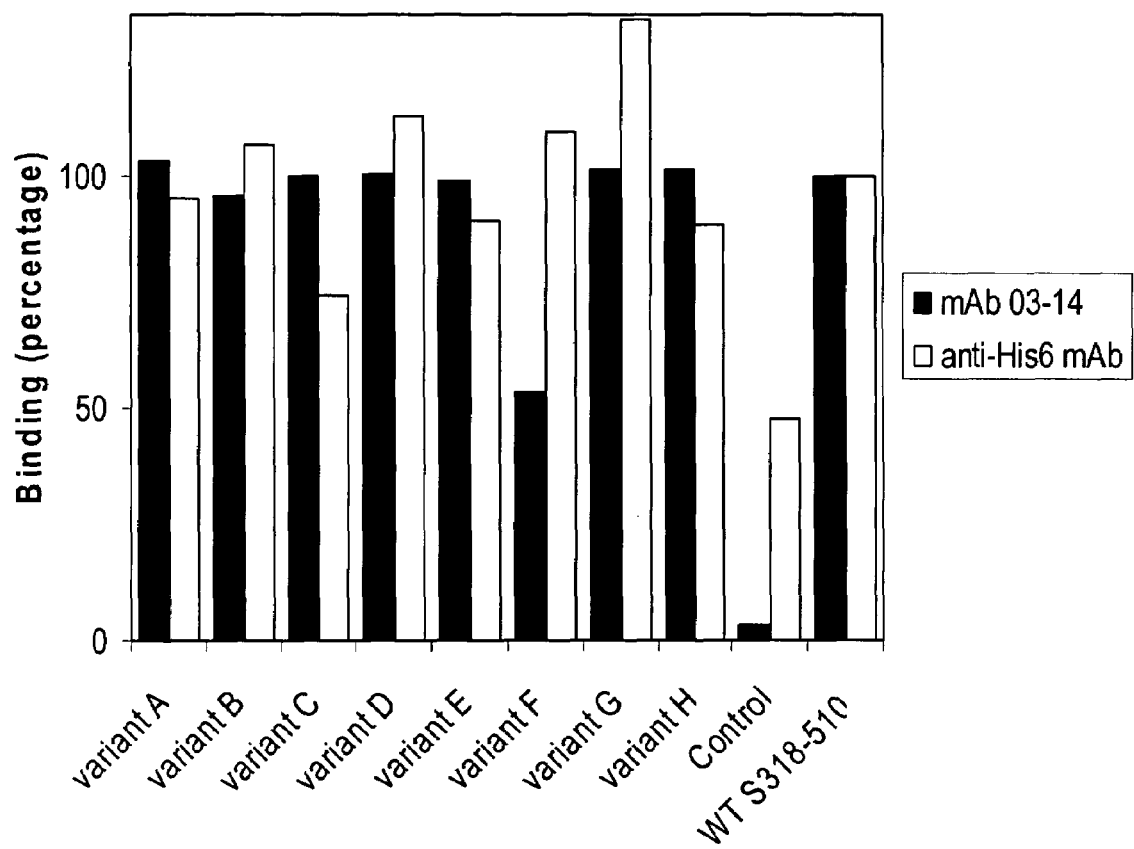
FIG. 25 shows binding of the monoclonal anti-SARS-CoV IgG1 antibody 03-014 and a control monoclonal anti-His6 antibody to the amino acid region of 318-510 of the S protein of the SARS-CoV strain Frankfurt 1 (called WT S318-510) and variant S318-510 fragments (variant A, mutation K344R; variant B, mutation S353F; variant C, mutation R426G and N437D; variant D, mutation Y436H; variant E, mutation Y442S; variant F, mutation N479S; variant G, mutation K344R, F360S, L472P, D480G, and T487S; variant H, mutation K344R, F501Y). The control is an irrelevant myc-His tagged protein. On the Y-axis is depicted the binding as percentage of binding to WT 318-510, which was set at 100% for both antibodies.

As shown in FIG. 25, the monoclonal anti-His 6 antibody and 03-014 were capable of binding all variant S318-510 fragments to a similar extent as the wild-type (non-mutated) S318-510 fragment, with the exception that the binding of monoclonal antibody 03-014 to variant F (N479S substitution) was approximately 50% of the binding to the other variant fragments and the wild-type S318-510 fragment. This indicates that residue N479 is involved in binding of 03-014, either directly by being part of the binding site of 03-014 or indirectly by being important for the correct conformation of the binding site of 03-014 within the spike protein. In conclusion, 03-014 is capable of binding the S318-510 region of the Frankfurt 1 strain and also of recombinant S318-510 fragments harboring mutations that can be found in the S318-510 region of the human SARS-CoV isolates described in Table 21. This suggests that 03-014 can be used to neutralize all currently known human SARS-CoV isolates.

Example 21

Screening Assay for Breadth of Protection of the Monoclonal anti-SARS-CoV Antibodies Different SARS-CoV strains were used to evaluate the potency and breadth of protection of the anti-SARS-CoV antibodies. The SARS-CoV strains HKU-36, HKU-39849, HKU-66, and HKU-61567 were passaged on FRhK-4 cells for two or three times before testing (see Table 22). Strain HKU-61644 was passaged on Vero cells and tested after passage 1 and 15. The SARS-CoV neutralization assay was performed on FRhK-4 cells as follows. A 500 µl 100 µg/ml stock solution of antibody was prepared in maintenance medium (MM, MEM supplemented with 1% fetal calf serum). From this stock solution, two-fold serial dilutions were prepared. 220 µl 100 µg/ml stock solution was added in duplo in a 96-well plate from which 110 µl was taken and mixed with 110 µl MM in each of the nine subsequent wells. 110 µl of the tenth well was discarded, which resulted in ten wells containing 110 µl 0.2-100 µg/ml antibody. 110 µl of the antibody dilution was mixed with 110 µl of the different SARS-CoV isolates at a concentration of 2000 TCID50/ml with the titer calculated according to the method of Reed and Muench. At this stage, in a 220 μl volume, antibody concentrations varied from 0.1 to 50 μg/ml in the presence of 1000 TCID50/ml SARS-CoV. The 96-well plate containing the antibody virus mixtures was preincubated for one to two hours at 37° C. 100 μl of the virus-antibody mixtures were added in quadruplicate to wells from a second 96-well tissue culture plate containing confluent FRhK-4 cells in 100 μl MM and incubated at 37° C. During this final incubation step, 100 TCID50 of SARS-CoV was present in the presence of antibody concentrations varying from 0.05 to 25 μg/ml. The cells were cultured at 37° C. and observed for the development of CPE at 72 and 96 hours. CPE is compared to a positive control (SARS-CoV inoculated cells) and a negative control (cells incubated with MM only). The antibody neutralization titer was determined as the concentration of antibody which gives 100% protection of the quadruplicate cell cultures. The monoclonal anti-SARS-CoV antibody 03-014 completely neutralized 100 TCID50 of all tested SARS-CoV isolates at a concentration of 12.5 μg/ml (see Table 22). This indicates that antibody 03-014 is able to neutralize a variety of SARS-CoV isolates.

TABLE 1

Binding of single-chain (scFv) phage antibodies to a SARS-CoV preparation (Frankfurt 1 strain) and to FBS as measured by ELISA.

| Name phage antibody | SARS-CoV preparation (OD492 nm) | FBS (OD492 nm) |
| --- | --- | --- |
| SC03-001 | 0.979 | 0.142 |
| SC03-002 | 0.841 | 0.091 |
| SC03-003 | 0.192 | 0.092 |
| SC03-005 | 0.869 | 0.098 |

TABLE 1-continued

Binding of single-chain (scFv) phage antibodies to a SARS-CoV preparation (Frankfurt 1 strain) and to FBS as measured by ELISA.

| Name phage antibody | SARS-CoV preparation (OD492 nm) | FBS (OD492 nm) |
| --- | --- | --- |
| SC03-006 | 1.056 | 0.086 |
| SC03-007 | 0.876 | 0.096 |
| SC03-008 | 0.358 | 0.114 |
| SC03-009 | 0.760 | 0.087 |
| SC03-010 | 0.327 | 0.082 |
| SC03-012 | 0.495 | 0.100 |
| SC03-013 | 0.979 | 0.101 |
| SC03-014 | 0.917 | 0.089 |
| SC03-015 | 0.796 | 0.077 |
| Anti-thyroglobulin (SC02-006) | 0.108 | 0.090 |
| No phage antibody | 0.072 | 0.083 |

TABLE 2

Binding of alternatively selected single-chain (scFv) phage antibodies to a SARS-CoV preparation (Frankfurt 1 strain) and to FBS as measured by ELISA.

| Name phage antibody | SARS-CoV preparation (OD492 nm) | FBS (OD492 nm) |
| --- | --- | --- |
| SC03-016 | 0.313 | 0.205 |
| SC03-017 | 0.106 | 0.059 |
| SC03-018 | 1.523 | 0.072 |
| Anti-CD46 (SC02-300) | 0.171 | 0.070 |
| No phage antibody | 0.081 | 0.045 |

TABLE 3

Data of the single-chain Fvs capable of binding SARS-CoV.

| Name scFv | SEQ ID NO of nucleotide sequence | SEQ ID NO of amino acid sequence | HCDR3 | $V_H$-germline | $V_L$-germline |
| --- | --- | --- | --- | --- | --- |
| SC03-001 | 46 | 47 | HRFRHVFDY | $V_H3$ $V_H3$-38 | $V_k$I DPK9 (02/012) |
| SC03-002 | 48 | 49 | YYSRSLKAFDY | $V_H3$ DP29 ($V_H3$-72) | $V_k$I DPK9 (02/012) |
| SC03-003 | 50 | 51 | RSYFRRFDY | $V_H3$ DP47 ($V_H3$-23) | $V_k$I DPK9 (02/012) |
| SC03-004 | 89 | 90 | DGSRFPARFDY | $V_H3$ ($V_H3$-73) | $V_k$I DPK9 (02/012) |
| SC03-005 | 52 | 53 | GGGRPYNPFDY | $V_H3$ $V_H3$-38 | $V_k$I DPK9 (02/012) |
| SC03-006 | 54 | 55 | DGSPRTPSFDY | $V_H3$ DP49 ($V_H3$-30) | $V_k$I DPK4 (A20) |
| SC03-007 | 56 | 57 | GYWTSLTGFDY | $V_H3$ DP49 ($V_H3$-30) | $V_k$I DPK9 (02/012) |
| SC03-008 | 58 | 59 | RVRPRRFDY | $V_H3$ DP47 ($V_H3$-23) | $V_k$I DPK9 (02/012) |
| SC03-009 | 60 | 61 | GLFMVTTYAFDY | $V_H3$ DP47 ($V_H3$-23) | $V_k$I DPK9 (02/012) |
| SC03-010 | 62 | 63 | GGGLPYLSFDY | $V_H3$ $V_H3$-38 | $V_k$I DPK9 (02/012) |

TABLE 3-continued

Data of the single-chain Fvs capable of binding SARS-CoV.

| Name scFv | SEQ ID NO of nucleotide sequence | SEQ ID NO of amino acid sequence | HCDR3 | $V_H$-germline | $V_L$-germline |
|---|---|---|---|---|---|
| SC03-012 | 64 | 65 | MFRKSSFDS | $V_H$1 DP14 ($V_H$1-18) | $V_L$III DPL16 (2-13, 31) |
| SC03-013 | 66 | 67 | GLTPLYFDY | $V_H$3 DP29 ($V_H$3-72) | $V_k$I DPK9 (O2/O12) |
| SC03-014 | 68 | 69 | GISPFYFDY | $V_H$3 DP29 ($V_H$3-72) | $V_k$I DPK9 (O2/O12) |
| SC03-015 | 70 | 71 | GLSLRP | $V_H$3 DP32 ($V_H$3-20) | $V_L$III DPL16 (2-13, 31) |
| SC03-016 | 91 | 92 | YGSAYRPPFDY | $V_H$3 ($V_H$3-49) | $V_k$I DPK9 (O2/O12) |
| SC03-017 | 93 | 94 | SRSAGFFDY | $V_H$4 DP66 ($V_H$4-61) | $V_k$III (L6) |
| SC03-018 | 95 | 96 | FNPFTSFDY | $V_H$3 DP47 ($V_H$3-23) | $V_k$I DPK9 (O2/O12) |

TABLE 4

Data of assay for SARS-CoV (strains Frankfurt 1 and Frankfurt 2) neutralising activity of bivalent scFvs.

| Name bivalent scFv | OD 280 (mg/ml) | Neutralization titer for Frankfurt 1 strain | Neutralization titer for Frankfurt 2 strain |
|---|---|---|---|
| pyBi03-001C02 | 0.0238 | <20 | <20 |
| pyBi03-002C02 | 0.0518 | <20 | <20 |
| pyBi03-003C02 | 0.0406 | <20 | <20 |
| pyBi03-005C02 | 0.0658 | <20 | <20 |
| pyBi03-006C02 | 0.0343 | <20 | <20 |
| pyBi03-007C02 | 0.0280 | <20 | <20 |
| pyBi03-008C02 | 0.0210 | <20 | <20 |
| pyBi03-009C02 | 0.0434 | <20 | <20 |
| pyBi03-010C02 | 0.0567 | <20 | <20 |
| pyBi03-012C02 | 0.0168 | <20 | <20 |
| pyBi03-013C02 | 0.1743 | 160 | 80 |
| pyBi03-014C02 | 0.1561 | 80 | 80 |
| pyBi03-015C02 | 0.4816 | <20 | <20 |
| pyBi02-148C02 | 0.0763 | <20 | <20 |
| pyBi02-006C02 | 0.0791 | <20 | <20 |
| Serum of SARS-patient | | 320 | 160 |

TABLE 5

Binding of recombinant human anti-SARS-antibodies to SARS-infected cells as measured by indirect immunofluorescence staining

| Antibody | Staining |
|---|---|
| Negative control | − |
| Positive control | + |
| 03-014 | + |
| 03-018 | + |

− indicates no staining of SARS-CoV transfected cells
+ indicates staining of SARS-CoV transfected cells

TABLE 6

Binding of antibody 03-018 to linear and looped/cyclic peptides of the N protein of SARS-CoV Urbani.

| Peptides of N protein | Antibody 03-018 linear peptides | Antibody 03-018 looped peptides |
|---|---|---|
| MSDNGPQSNQRSAPR | 0.1 | 0.3 |
| SDNGPQSNQRSAPRI | 0.0 | 0.2 |
| DNGPQSNQRSAPRIT | 0.2 | 0.3 |
| NGPQSNQRSAPRITF | 1.6 | 0.3 |
| GPQSNQRSAPRITFG | 3.2 | 0.3 |
| PQSNQRSAPRITFGG | 3.3 | 4.7 |
| QSNQRSAPRITFGGP | 2.9 | 4.1 |
| SNQRSAPRITFGGPT | 3.3 | 2.2 |
| NQRSAPRITFGGPTD | 3.9 | 1.4 |
| QRSAPRITFGGPTDS | 2.6 | 3.9 |
| RSAPRITFGGPTDST | 2.5 | 1.6 |
| SAPRITFGGPTDSTD | 1.4 | 0.6 |
| APRITFGGPTDSTDN | 2.3 | 0.5 |
| PRITFGGPTDSTDNN | 1.6 | 0.3 |

TABLE 6-continued

Binding of antibody 03-018 to linear and looped/cyclic peptides of the N protein of SARS-CoV Urbani.

| Peptides of N protein | Antibody 03-018 linear peptides | Antibody 03-018 looped peptides |
|---|---|---|
| RITFGGPTDSTDNNQ | 0.5 | 0.2 |
| ITFGGPTDSTDNNQN | 1.2 | 0.3 |
| TFGGPTDSTDNNQNG | 0.1 | 0.2 |
| FGGPTDSTDNNQNGG | 0.1 | 0.2 |
| GGPTDSTDNNQNGGR | 0.1 | 0.2 |
| GPTDSTDNNQNGGRN | 0.2 | 0.2 |
| PTDSTDNNQNGGRNG | 0.1 | 0.2 |
| TDSTDNNQNGGRNGA | 0.2 | 0.2 |
| DSTDNNQNGGRNGAR | 0.2 | 0.3 |
| STDNNQNGGRNGARP | 0.2 | 0.2 |
| TDNNQNGGRNGARPK | 0.2 | 0.2 |
| DNNQNGGRNGARPKQ | 0.2 | 0.3 |
| NNQNGGRNGARPKQR | 0.2 | 0.2 |
| NQNGGRNGARPKQRR | 0.2 | 0.2 |
| QNGGRNGARPKQRRP | 0.2 | 0.3 |
| NGGRNGARPKQRRPQ | 0.2 | 0.3 |
| GGRNGARPKQRRPQG | 0.2 | 0.2 |
| GRNGARPKQRRPQGL | 0.1 | 0.2 |
| RNGARPKQRRPQGLP | 0.1 | 0.3 |
| NGARPKQRRPQGLPN | 0.1 | 0.3 |
| GARPKQRRPQGLPNN | 0.1 | 0.2 |
| ARPKQRRPQGLPNNT | 0.1 | 0.2 |
| RPKQRRPQGLPNNTA | 0.1 | 0.2 |
| PKQRRPQGLPNNTAS | 0.2 | 0.3 |
| KQRRPQGLPNNTASW | 0.1 | 0.2 |
| QRRPQGLPNNTASWF | 0.1 | 0.2 |
| RRPQGLPNNTASWFT | 0.1 | 0.2 |
| RPQGLPNNTASWFTA | 0.1 | 0.2 |
| PQGLPNNTASWFTAL | 0.1 | 0.3 |
| QGLPNNTASWFTALT | 0.1 | 0.3 |
| GLPNNTASWFTALTQ | 0.1 | 0.3 |
| LPNNTASWFTALTQH | 0.1 | 0.3 |
| PNNTASWFTALTQHG | 0.1 | 0.3 |
| NNTASWFTALTQHGK | 0.1 | 0.2 |
| NTASWFTALTQHGKE | 0.1 | 0.2 |
| TASWFTALTQHGKEE | 0.1 | 0.2 |
| ASWFTALTQHGKEEL | 0.1 | 0.2 |
| SWFTALTQHGKEELR | 0.1 | 0.2 |
| WFTALTQHGKEELRF | 0.1 | 0.2 |
| FTALTQHGKEELRFP | 0.1 | 0.2 |
| TALTQHGKEELRFPR | 0.1 | 0.3 |
| ALTQHGKEELRFPRG | 0.2 | 0.2 |
| LTQHGKEELRFPRGQ | 0.1 | 0.2 |
| TQHGKEELRFPRGQG | 0.1 | 0.2 |
| QHGKEELRFPRGQGV | 0.1 | 0.2 |
| HGKEELRFPRGQGVP | 0.1 | 0.2 |
| GKEELRFPRGQGVPI | 0.1 | 0.3 |
| KEELRFPRGQGVPIN | 0.1 | 0.3 |
| EELRFPRGQGVPINT | 0.1 | 0.3 |
| ELRFPRGQGVPINTN | 0.1 | 0.2 |
| LRFPRGQGVPINTNS | 0.1 | 0.2 |
| RFPRGQGVPINTNSG | 0.1 | 0.2 |
| FPRGQGVPINTNSGP | 0.1 | 0.2 |
| PRGQGVPINTNSGPD | 0.1 | 0.2 |
| RGQGVPINTNSGPDD | 0.1 | 0.2 |
| GQGVPINTNSGPDDQ | 0.1 | 0.2 |
| QGVPINTNSGPDDQI | 0.1 | 0.1 |
| GVPINTNSGPDDQIG | 0.1 | 0.2 |
| VPINTNSGPDDQIGY | 0.1 | 0.2 |
| PINTNSGPDDQIGYY | 0.1 | 0.2 |
| INTNSGPDDQIGYYR | 0.1 | 0.2 |
| NTNSGPDDQIGYYRR | 0.1 | 0.3 |
| TNSGPDDQIGYYRRA | 0.1 | 0.2 |
| NSGPDDQIGYYRRAT | 0.1 | 0.2 |
| SGPDDQIGYYRRATR | 0.1 | 0.3 |
| GPDDQIGYYRRATRR | 0.1 | 0.3 |
| PDDQIGYYRRATRRV | 0.1 | 0.3 |
| DDQIGYYRRATRRVR | 0.1 | 0.3 |
| DQIGYYRRATRRVRG | 0.1 | 0.3 |
| QIGYYRRATRRVRGG | 0.1 | 0.2 |
| IGYYRRATRRVRGGD | 0.1 | 0.2 |
| GYYRRATRRVRGGDG | 0.1 | 0.2 |
| YYRRATRRVRGGDGK | 0.1 | 0.2 |
| YRRATRRVRGGDGKM | 0.1 | 0.2 |
| RRATRRVRGGDGKMK | 0.1 | 0.2 |
| RATRRVRGGDGKMKE | 0.1 | 0.2 |
| ATRRVRGGDGKMKEL | 0.1 | 0.2 |
| TRRVRGGDGKMKELS | 0.1 | 0.2 |
| RRVRGGDGKMKELSP | 0.1 | 0.2 |
| RVRGGDGKMKELSPR | 0.1 | 0.2 |
| VRGGDGKMKELSPRW | 0.1 | 0.2 |
| RGGDGKMKELSPRWY | 0.1 | 0.2 |
| GGDGKMKELSPRWYF | 0.1 | 0.2 |
| GDGKMKELSPRWYFY | 0.1 | 0.2 |
| DGKMKELSPRWYFYY | 0.1 | 0.2 |
| GKMKELSPRWYFYYL | 0.1 | 0.3 |
| KMKELSPRWYFYYLG | 0.1 | 0.2 |
| MKELSPRWYFYYLGT | 0.1 | 0.2 |
| KELSPRWYFYYLGTG | 0.1 | 0.3 |
| ELSPRWYFYYLGTGP | 0.1 | 0.2 |
| LSPRWYFYYLGTGPE | 0.1 | 0.2 |
| SPRWYFYYLGTGPEA | 0.1 | 0.2 |
| PRWYFYYLGTGPEAS | 0.1 | 0.2 |
| RWYFYYLGTGPEASL | 0.1 | 0.2 |
| WYFYYLGTGPEASLP | 0.1 | 0.2 |
| YFYYLGTGPEASLPY | 0.1 | 0.2 |
| FYYLGTGPEASLPYG | 0.1 | 0.2 |
| YYLGTGPEASLPYGA | 0.1 | 0.2 |
| YLGTGPEASLPYGAN | 0.1 | 0.2 |
| LGTGPEASLPYGANK | 0.1 | 0.2 |
| GTGPEASLPYGANKE | 0.1 | 0.2 |
| TGPEASLPYGANKEG | 0.1 | 0.2 |
| GPEASLPYGANKEGI | 0.1 | 0.2 |
| PEASLPYGANKEGIV | 0.1 | 0.2 |
| EASLPYGANKEGIVW | 0.1 | 0.2 |
| ASLPYGANKEGIVWV | 0.1 | 0.3 |
| SLPYGANKEGIVWVA | 0.1 | 0.2 |
| LPYGANKEGIVWVAT | 0.1 | 0.2 |
| PYGANKEGIVWVATE | 0.1 | 0.2 |
| YGANKEGIVWVATEG | 0.1 | 0.2 |
| GANKEGIVWVATEGA | 0.1 | 0.2 |
| ANKEGIVWVATEGAL | 0.1 | 0.2 |
| NKEGIVWVATEGALN | 0.1 | 0.2 |
| KEGIVWVATEGALNT | 0.1 | 0.2 |
| EGIVWVATEGALNTP | 0.1 | 0.2 |
| GIVWVATEGALNTPK | 0.1 | 0.2 |
| IVWVATEGALNTPKD | 0.1 | 0.2 |
| VWVATEGALNTPKDH | 0.1 | 0.3 |
| WVATEGALNTPKDHI | 0.1 | 0.2 |
| VATEGALNTPKDHIG | 0.2 | 0.2 |
| ATEGALNTPKDHIGT | 0.1 | 0.2 |
| TEGALNTPKDHIGTR | 0.2 | 0.3 |
| EGALNTPKDHIGTRN | 0.1 | 0.3 |
| GALNTPKDHIGTRNP | 0.1 | 0.2 |
| ALNTPKDHIGTRNPN | 0.1 | 0.2 |
| LNTPKDHIGTRNPNN | 0.1 | 0.2 |
| NTPKDHIGTRNPNNN | 0.1 | 0.2 |
| TPKDHIGTRNPNNNA | 0.1 | 0.2 |
| PKDHIGTRNPNNNAA | 0.1 | 0.2 |
| KDHIGTRNPNNNAAT | 0.1 | 0.2 |
| DHIGTRNPNNNAATV | 0.1 | 0.3 |
| HIGTRNPNNNAATVL | 0.1 | 0.3 |
| IGTRNPNNNAATVLQ | 0.1 | 0.3 |
| GTRNPNNNAATVLQL | 0.1 | 0.3 |
| TRNPNNNAATVLQLP | 0.1 | 0.2 |
| RNPNNNAATVLQLPQ | 0.1 | 0.2 |
| NPNNNAATVLQLPQG | 0.1 | 0.3 |
| PNNNAATVLQLPQGT | 0.1 | 0.3 |
| NNNAATVLQLPQGTT | 0.1 | 0.3 |
| NNAATVLQLPQGTTL | 0.1 | 0.3 |
| NAATVLQLPQGTTLP | 0.1 | 0.2 |
| AATVLQLPQGTTLPK | 0.1 | 0.2 |

TABLE 6-continued

Binding of antibody 03-018 to linear and looped/cyclic peptides of the N protein of SARS-CoV Urbani.

| Peptides of N protein | Antibody 03-018 linear peptides | Antibody 03-018 looped peptides |
|---|---|---|
| ATVLQLPQGTTLPKG | 0.1 | 0.2 |
| TVLQLPQGTTLPKGF | 0.1 | 0.3 |
| VLQLPQGTTLPKGFY | 0.1 | 0.3 |
| LQLPQGTTLPKGFYA | 0.1 | 0.2 |
| QLPQGTTLPKGFYAE | 0.1 | 0.2 |
| LPQGTTLPKGFYAEG | 0.1 | 0.3 |
| PQGTTLPKGFYAEGS | 0.1 | 0.2 |
| QGTTLPKGFYAEGSR | 0.1 | 0.2 |
| GTTLPKGFYAEGSRG | 0.1 | 0.2 |
| TTLPKGFYAEGSRGG | 0.1 | 0.2 |
| TLPKGFYAEGSRGGS | 0.1 | 0.2 |
| LPKGFYAEGSRGGSQ | 0.1 | 0.2 |
| PKGFYAEGSRGGSQA | 0.1 | 0.2 |
| KGFYAEGSRGGSQAS | 0.1 | 0.2 |
| GFYAEGSRGGSQASS | 0.1 | 0.2 |
| FYAEGSRGGSQASSR | 0.1 | 0.1 |
| YAEGSRGGSQASSRS | 0.1 | 0.2 |
| AEGSRGGSQASSRSS | 0.1 | 0.2 |
| EGSRGGSQASSRSSS | 0.1 | 0.2 |
| GSRGGSQASSRSSSR | 0.1 | 0.2 |
| SRGGSQASSRSSSRS | 0.1 | 0.2 |
| RGGSQASSRSSSRSR | 0.1 | 0.1 |
| GGSQASSRSSSRSRG | 0.1 | 0.2 |
| GSQASSRSSSRSRGN | 0.1 | 0.2 |
| SQASSRSSSRSRGNS | 0.1 | 0.2 |
| QASSRSSSRSRGNSR | 0.1 | 0.2 |
| ASSRSSSRSRGNSRN | 0.1 | 0.2 |
| SSRSSSRSRGNSRNS | 0.1 | 0.2 |
| SRSSSRSRGNSRNST | 0.1 | 0.2 |
| RSSSRSRGNSRNSTP | 0.1 | 0.2 |
| SSSRSRGNSRNSTPG | 0.1 | 0.2 |
| SSRSRGNSRNSTPGS | 0.1 | 0.2 |
| SRSRGNSRNSTPGSS | 0.1 | 0.2 |
| RSRGNSRNSTPGSSR | 0.1 | 0.2 |
| SRGNSRNSTPGSSRG | 0.1 | 0.2 |
| RGNSRNSTPGSSRGN | 0.1 | 0.2 |
| GNSRNSTPGSSRGNS | 0.1 | 0.2 |
| NSRNSTPGSSRGNSP | 0.1 | 0.2 |
| SRNSTPGSSRGNSPA | 0.1 | 0.2 |
| RNSTPGSSRGNSPAR | 0.1 | 0.2 |
| NSTPGSSRGNSPARM | 0.2 | 0.3 |
| STPGSSRGNSPARMA | 0.1 | 0.2 |
| TPGSSRGNSPARMAS | 0.1 | 0.3 |
| PGSSRGNSPARMASG | 0.1 | 0.3 |
| GSSRGNSPARMASGG | 0.1 | 0.2 |
| SSRGNSPARMASGGG | 0.1 | 0.2 |
| SRGNSPARMASGGGE | 0.1 | 0.2 |
| RGNSPARMASGGGET | 0.1 | 0.2 |
| GNSPARMASGGGETA | 0.2 | 0.2 |
| NSPARMASGGGETAL | 0.1 | 0.2 |
| SPARMASGGGETALA | 0.1 | 0.1 |
| PARMASGGGETALAL | 0.1 | 0.3 |
| ARMASGGGETALALL | 0.1 | 0.3 |
| RMASGGGETALALLL | 0.1 | 0.3 |
| MASGGGETALALLLL | 0.1 | 0.3 |
| ASGGGETALALLLLD | 0.1 | 0.2 |
| SGGGETALALLLLDR | 0.1 | 0.2 |
| GGGETALALLLLDRL | 0.1 | 0.2 |
| GGETALALLLLDRLN | 0.1 | 0.2 |
| GETALALLLLDRLNQ | 0.1 | 0.3 |
| ETALALLLLDRLNQL | 0.1 | 0.3 |
| TALALLLLDRLNQLE | 0.1 | 0.2 |
| ALALLLLDRLNQLES | 0.1 | 0.3 |
| LALLLLDRLNQLESK | 0.1 | 0.2 |
| ALLLLDRLNQLESKV | 0.1 | 0.3 |
| LLLLDRLNQLESKVS | 0.2 | 0.2 |
| LLLDRLNQLESKVSG | 0.1 | 0.2 |
| LLDRLNQLESKVSGK | 0.1 | 0.2 |
| LDRLNQLESKVSGKG | 0.1 | 0.2 |
| DRLNQLESKVSGKGQ | 0.1 | 0.3 |
| RLNQLESKVSGKGQQ | 0.1 | 0.2 |
| LNQLESKVSGKGQQQ | 0.1 | 0.3 |
| NQLESKVSGKGQQQQ | 0.1 | 0.3 |
| QLESKVSGKGQQQQG | 0.1 | 0.3 |
| LESKVSGKGQQQQGQ | 0.1 | 0.3 |
| ESKVSGKGQQQQGQT | 0.1 | 0.2 |
| SKVSGKGQQQQGQTV | 0.1 | 0.2 |
| KVSGKGQQQQGQTVT | 0.1 | 0.2 |
| VSGKGQQQQGQTVTK | 0.1 | 0.3 |
| SGKGQQQQGQTVTKK | 0.1 | 0.2 |
| GKGQQQQGQTVTKKS | 0.1 | 0.2 |
| KGQQQQGQTVTKKSA | 0.1 | 0.2 |
| GQQQQGQTVTKKSAA | 0.1 | 0.2 |
| QQQQGQTVTKKSAAE | 0.1 | 0.2 |
| QQQGQTVTKKSAAEA | 0.1 | 0.2 |
| QQGQTVTKKSAAEAS | 0.1 | 0.2 |
| QGQTVTKKSAAEASK | 0.1 | 0.2 |
| GQTVTKKSAAEASKK | 0.1 | 0.2 |
| QTVTKKSAAEASKKP | 0.1 | 0.2 |
| TVTKKSAAEASKKPR | 0.1 | 0.2 |
| VTKKSAAEASKKPRQ | 0.1 | 0.2 |
| TKKSAAEASKKPRQK | 0.1 | 0.2 |
| KKSAAEASKKPRQKR | 0.1 | 0.2 |
| KSAAEASKKPRQKRT | 0.1 | 0.1 |
| SAAEASKKPRQKRTA | 0.1 | 0.2 |
| AAEASKKPRQKRTAT | 0.1 | 0.2 |
| AEASKKPRQKRTATK | 0.1 | 0.2 |
| EASKKPRQKRTATKQ | 0.1 | 0.3 |
| ASKKPRQKRTATKQY | 0.1 | 0.2 |
| SKKPRQKRTATKQYN | 0.1 | 0.2 |
| KKPRQKRTATKQYNV | 0.1 | 0.2 |
| KPRQKRTATKQYNVT | 0.1 | 0.2 |
| PRQKRTATKQYNVTQ | 0.1 | 0.2 |
| RQKRTATKQYNVTQA | 0.1 | 0.2 |
| QKRTATKQYNVTQAF | 0.1 | 0.2 |
| KRTATKQYNVTQAFG | 0.1 | 0.2 |
| RTATKQYNVTQAFGR | 0.1 | 0.2 |
| TATKQYNVTQAFGRR | 0.1 | 0.3 |
| ATKQYNVTQAFGRRG | 0.1 | 0.3 |
| TKQYNVTQAFGRRGP | 0.1 | 0.3 |
| KQYNVTQAFGRRGPE | 0.1 | 0.1 |
| QYNVTQAFGRRGPEQ | 0.1 | 0.3 |
| YNVTQAFGRRGPEQT | 0.1 | 0.2 |
| NVTQAFGRRGPEQTQ | 0.1 | 0.2 |
| VTQAFGRRGPEQTQG | 0.1 | 0.2 |
| TQAFGRRGPEQTQGN | 0.1 | 0.2 |
| QAFGRRGPEQTQGNF | 0.1 | 0.2 |
| AFGRRGPEQTQGNFG | 0.1 | 0.2 |
| FGRRGPEQTQGNFGD | 0.1 | 0.1 |
| GRRGPEQTQGNFGDQ | 0.1 | 0.2 |
| RRGPEQTQGNFGDQD | 0.1 | 0.2 |
| RGPEQTQGNFGDQDL | 0.1 | 0.2 |
| GPEQTQGNFGDQDLI | 0.1 | 0.2 |
| PEQTQGNFGDQDLIR | 0.1 | 0.2 |
| EQTQGNFGDQDLIRQ | 0.1 | 0.0 |
| QTQGNFGDQDLIRQG | 0.1 | 0.2 |
| TQGNFGDQDLIRQGT | 0.1 | 0.2 |
| QGNFGDQDLIRQGTD | 0.1 | 0.2 |
| GNFGDQDLIRQGTDY | 0.1 | 0.2 |
| NFGDQDLIRQGTDYK | 0.1 | 0.2 |
| FGDQDLIRQGTDYKH | 0.1 | 0.2 |
| GDQDLIRQGTDYKHW | 0.1 | 0.2 |
| DQDLIRQGTDYKHWP | 0.1 | 0.2 |
| QDLIRQGTDYKHWPQ | 0.1 | 0.2 |
| DLIRQGTDYKHWPQI | 0.1 | 0.2 |
| LIRQGTDYKHWPQIA | 0.1 | 0.1 |
| IRQGTDYKHWPQIAQ | 0.1 | 0.2 |
| RQGTDYKHWPQIAQF | 0.1 | 0.2 |
| QGTDYKHWPQIAQFA | 0.1 | 0.2 |
| GTDYKHWPQIAQFAP | 0.1 | 0.2 |
| TDYKHWPQIAQFAPS | 0.1 | 0.2 |
| DYKHWPQIAQFAPSA | 0.1 | 0.2 |
| YKHWPQIAQFAPSAS | 0.1 | 0.2 |
| KHWPQIAQFAPSASA | 0.1 | 0.2 |
| HWPQIAQFAPSASAF | 0.1 | 0.2 |
| WPQIAQFAPSASAFF | 0.1 | 0.3 |

TABLE 6-continued

Binding of antibody 03-018 to linear and looped/cyclic peptides of the N protein of SARS-CoV Urbani.

| Peptides of N protein | Antibody 03-018 linear peptides | Antibody 03-018 looped peptides |
|---|---|---|
| PQIAQFAPSASAFFG | 0.1 | 0.2 |
| QIAQFAPSASAFFGM | 0.1 | 0.3 |
| IAQFAPSASAFFGMS | 0.1 | 0.3 |
| AQFAPSASAFFGMSR | 0.1 | 0.3 |
| QFAPSASAFFGMSRI | 0.1 | 0.3 |
| FAPSASAFFGMSRIG | 0.1 | 0.2 |
| APSASAFFGMSRIGM | 0.1 | 0.2 |
| PSASAFFGMSRIGME | 0.1 | 0.2 |
| SASAFFGMSRIGMEV | 0.1 | 0.2 |
| ASAFFGMSRIGMEVT | 0.1 | 0.2 |
| SAFFGMSRIGMEVTP | 0.1 | 0.2 |
| AFFGMSRIGMEVTPS | 0.1 | 0.2 |
| FFGMSRIGMEVTPSG | 0.1 | 0.2 |
| FGMSRIGMEVTPSGT | 0.1 | 0.2 |
| GMSRIGMEVTPSGTW | 0.1 | 0.2 |
| MSRIGMEVTPSGTWL | 0.1 | 0.2 |
| SRIGMEVTPSGTWLT | 0.1 | 0.2 |
| RIGMEVTPSGTWLTY | 0.1 | 0.2 |
| IGMEVTPSGTWLTYH | 0.1 | 0.2 |
| GMEVTPSGTWLTYHG | 0.1 | 0.2 |
| MEVTPSGTWLTYHGA | 0.1 | 0.2 |
| EVTPSGTWLTYHGAI | 0.1 | 0.2 |
| VTPSGTWLTYHGAIK | 0.1 | 0.2 |
| TPSGTWLTYHGAIKL | 0.1 | 0.2 |
| PSGTWLTYHGAIKLD | 0.1 | 0.2 |
| SGTWLTYHGAIKLDD | 0.1 | 0.2 |
| GTWLTYHGAIKLDDK | 0.1 | 0.2 |
| TWLTYHGAIKLDDKD | 0.1 | 0.2 |
| WLTYHGAIKLDDKDP | 0.1 | 0.2 |
| LTYHGAIKLDDKDPQ | 0.1 | 0.2 |
| TYHGAIKLDDKDPQF | 0.1 | 0.1 |
| YHGAIKLDDKDPQFK | 0.1 | 0.2 |
| HGAIKLDDKDPQFKD | 0.1 | 0.2 |
| GAIKLDDKDPQFKDN | 0.1 | 0.2 |
| AIKLDDKDPQFKDNV | 0.1 | 0.2 |
| IKLDDKDPQFKDNVI | 0.1 | 0.2 |
| KLDDKDPQFKDNVIL | 0.1 | 0.2 |
| LDDKDPQFKDNVILL | 0.1 | 0.3 |
| DDKDPQFKDNVILLN | 0.1 | 0.3 |
| DKDPQFKDNVILLNK | 0.1 | 0.4 |
| KDPQFKDNVILLNKH | 0.1 | 0.2 |
| DPQFKDNVILLNKHI | 0.1 | 0.3 |
| PQFKDNVILLNKHID | 0.1 | 0.2 |
| QFKDNVILLNKHIDA | 0.1 | 0.3 |
| FKDNVILLNKHIDAY | 0.1 | 0.2 |
| KDNVILLNKHIDAYK | 0.1 | 0.2 |
| DNVILLNKHIDAYKT | 0.1 | 0.2 |
| NVILLNKHIDAYKTF | 0.1 | 0.2 |
| VILLNKHIDAYKTFP | 0.1 | 0.2 |
| ILLNKHIDAYKTFPP | 0.1 | 0.2 |
| LLNKHIDAYKTFPPT | 0.1 | 0.2 |
| LNKHIDAYKTFPPTE | 0.1 | 0.2 |
| NKHIDAYKTFPPTEP | 0.1 | 0.2 |
| KHIDAYKTFPPTEPK | 0.1 | 0.2 |
| HIDAYKTFPPTEPKK | 0.1 | 0.2 |
| IDAYKTFPPTEPKKD | 0.1 | 0.2 |
| DAYKTFPPTEPKKDK | 0.1 | 0.2 |
| AYKTFPPTEPKKDKK | 0.1 | 0.1 |
| YKTFPPTEPKKDKKK | 0.1 | 0.2 |
| KTFPPTEPKKDKKKK | 0.1 | 0.2 |
| TFPPTEPKKDKKKKT | 0.1 | 0.2 |
| FPPTEPKKDKKKKTD | 0.1 | 0.2 |
| PPTEPKKDKKKKTDE | 0.1 | 0.2 |
| PTEPKKDKKKKTDEA | 0.1 | 0.2 |
| TEPKKDKKKKTDEAQ | 0.1 | 0.2 |
| EPKKDKKKKTDEAQP | 0.1 | 0.2 |
| PKKDKKKKTDEAQPL | 0.1 | 0.2 |
| KKDKKKKTDEAQPLP | 0.1 | 0.2 |
| KDKKKKTDEAQPLPQ | 0.1 | 0.2 |
| DKKKKTDEAQPLPQR | 0.1 | 0.2 |
| KKKKTDEAQPLPQRQ | 0.1 | 0.2 |
| KKKTDEAQPLPQRQK | 0.1 | 0.2 |
| KKTDEAQPLPQRQKK | 0.1 | 0.2 |
| KTDEAQPLPQRQKKQ | 0.1 | 0.2 |
| TDEAQPLPQRQKKQP | 0.1 | 0.1 |
| DEAQPLPQRQKKQPT | 0.1 | 0.2 |
| EAQPLPQRQKKQPTV | 0.1 | 0.2 |
| AQPLPQRQKKQPTVT | 0.1 | 0.1 |
| QPLPQRQKKQPTVTL | 0.1 | 0.3 |
| PLPQRQKKQPTVTLL | 0.1 | 0.3 |
| LPQRQKKQPTVTLLP | 0.1 | 0.3 |
| PQRQKKQPTVTLLPA | 0.1 | 0.3 |
| QRQKKQPTVTLLPAA | 0.1 | 0.3 |
| RQKKQPTVTLLPAAD | 0.1 | 0.2 |
| QKKQPTVTLLPAADM | 0.1 | 0.3 |
| KKQPTVTLLPAADMD | 0.1 | 0.2 |
| KQPTVTLLPAADMDD | 0.1 | 0.2 |
| QPTVTLLPAADMDDF | 0.1 | 0.2 |
| PTVTLLPAADMDDFS | 0.1 | 0.2 |
| TVTLLPAADMDDFSR | 0.1 | 0.2 |
| VTLLPAADMDDFSRQ | 0.1 | 0.2 |
| TLLPAADMDDFSRQL | 0.1 | 0.1 |
| LLPAADMDDFSRQLQ | 0.1 | 0.2 |
| LPAADMDDFSRQLQN | 0.1 | 0.2 |
| PAADMDDFSRQLQNS | 0.1 | 0.2 |
| AADMDDFSRQLQNSM | 0.2 | 0.2 |
| ADMDDFSRQLQNSMS | 0.1 | 0.1 |
| DMDDFSRQLQNSMSG | 0.1 | 0.2 |
| MDDFSRQLQNSMSGA | 0.2 | 0.2 |
| DDFSRQLQNSMSGAS | 0.2 | 0.2 |
| DFSRQLQNSMSGASA | 0.1 | 0.2 |
| FSRQLQNSMSGASAD | 0.1 | 0.2 |
| SRQLQNSMSGASADS | 0.1 | 0.2 |
| RQLQNSMSGASADST | 0.1 | 0.2 |
| QLQNSMSGASADSTQ | 0.1 | 0.2 |
| LQNSMSGASADSTQA | 0.2 | 0.2 |

TABLE 7

Data of assay for SARS-CoV (Hong Kong strain obtained from patient 5688) neutralizing activity of human monoclonal anti-SARS-CoV antibodies.

| TCID$_{50}$/ Antibody | Conc. (μg/ml) | | | | | | | | | | | |
|---|---|---|---|---|---|---|---|---|---|---|---|---|
| | 50.00 | 25.00 | 12.50 | 6.25 | 3.12 | 1.56 | 0.78 | 0.39 | 0.20 | 0.10 | 0.05 | 0.02 |
| 10/02-027 | 3+ | 3+ | 3+ | 3+ | 3+ | 3+ | 3+ | 3+ | 3+ | 3+ | 3+ | 3+ |
| 10/02-027 | 3+ | 3+ | 3+ | 3+ | 3+ | 3+ | 3+ | 3+ | 3+ | 3+ | 3+ | 3+ |
| 10/02-027 | 3+ | 3+ | 3+ | 3+ | 3+ | 3+ | 3+ | 3+ | 3+ | 3+ | 3+ | 3+ |
| 10/03-013 | − | − | + | − | + | + | + | 3+ | 3+ | 3+ | 3+ | 3+ |
| 10/03-013 | − | − | − | − | − | − | − | 2+ | 2+ | 3+ | 3+ | 3+ |
| 10/03-013 | − | − | − | − | + | − | 2+ | 2+ | 3+ | 3+ | 3+ | 3+ |

TABLE 7-continued

Data of assay for SARS-CoV (Hong Kong strain obtained from patient 5688) neutralizing activity of human monoclonal anti-SARS-CoV antibodies.

| TCID$_{50}$/ Antibody | Conc. (μg/ml) | | | | | | | | | | | |
|---|---|---|---|---|---|---|---|---|---|---|---|---|
| | 50.00 | 25.00 | 12.50 | 6.25 | 3.12 | 1.56 | 0.78 | 0.39 | 0.20 | 0.10 | 0.05 | 0.02 |
| 10/03-014 | − | − | − | − | − | − | − | − | 2+ | 3+ | 3+ | 3+ |
| 10/03-014 | − | − | − | − | − | − | − | + | + | 2+ | 3+ | 3+ |
| 10/03-014 | − | − | − | − | − | − | + | 2+ | 3+ | 3+ | 3+ | 3+ |
| 30/02-027 | 3+ | 3+ | 3+ | 3+ | 3+ | 3+ | 3+ | 3+ | 3+ | 3+ | 3+ | 3+ |
| 30/02-027 | 3+ | 3+ | 3+ | 3+ | 3+ | 3+ | 3+ | 3+ | 3+ | 3+ | 3+ | 3+ |
| 30/02-027 | 3+ | 3+ | 3+ | 3+ | 3+ | 3+ | 3+ | 3+ | 3+ | 3+ | 3+ | 3+ |
| 30/03-013 | − | − | − | − | − | − | 2+ | 2+ | 3+ | 3+ | 3+ | 3+ |
| 30/03-013 | − | − | − | − | + | + | 2+ | 3+ | 3+ | 3+ | 3+ | 3+ |
| 30/03-013 | − | − | − | + | + | 2+ | 2+ | 3+ | 3+ | 3+ | 3+ | 3+ |
| 30/03-014 | − | − | − | − | − | + | + | 3+ | 3+ | 3+ | 3+ | 3+ |
| 30/03-014 | − | − | + | − | − | − | − | + | 2+ | 3+ | 3+ | 3+ |
| 30/03-014 | − | − | − | − | − | − | + | + | 2+ | 3+ | 3+ | 3+ |
| 100/02-027 | 3+ | 3+ | 3+ | 3+ | 3+ | 3+ | 3+ | 3+ | 3+ | 3+ | 3+ | 3+ |
| 100/02-027 | 3+ | 3+ | 3+ | 3+ | 3+ | 3+ | 3+ | 3+ | 3+ | 3+ | 3+ | 3+ |
| 100/02-027 | 3+ | 3+ | 3+ | 3+ | 3+ | 3+ | 3+ | 3+ | 3+ | 3+ | 3+ | 3+ |
| 100/03-013 | − | − | − | + | + | + | 2+ | 3+ | 3+ | 3+ | 3+ | 3+ |
| 100/03-013 | − | − | + | + | + | 2+ | 3+ | 3+ | 3+ | 3+ | 3+ | 3+ |
| 100/03-013 | − | − | + | + | + | 2+ | 3+ | 3+ | 3+ | 3+ | 3+ | 3+ |
| 100/03-014 | − | − | − | − | − | + | 2+ | 2+ | 3+ | 3+ | 3+ | 3+ |
| 100/03-014 | − | − | − | − | + | + | 2+ | 2+ | 3+ | 3+ | 3+ | 3+ |
| 100/03-014 | − | − | − | − | + | + | 2+ | 2+ | 3+ | 3+ | 3+ | 3+ |

−: No CPE
+: CPE ≦ 50%
2+: CPE 50-90%
3+: CPE 100%

TABLE 8

Human IgG heavy chain variable region primers (sense).

| Primer name | Primer nucleotide sequence | SEQ ID NO |
|---|---|---|
| HuVH1B/7A | 5'-CAGRTGCAGCTGGTG CARTCTGG-3' | SEQ ID NO: 132 |
| HuVH1C | 5'-SAGGTCCAGCTGGTR CAGTCTGG-3' | SEQ ID NO: 133 |
| HuVH2B | 5'-SAGGTGCAGCTGGTG GAGTCTGG-3' | SEQ ID NO: 134 |
| HuVH3B | 5'-SAGGTGCAGCTGGTG GAGTCTGG-3' | SEQ ID NO: 135 |
| HuVH3C | 5'-GAGGTGCAGCTGGTG GAGWCYGG-3' | SEQ ID NO: 136 |
| HuVH4B | 5'-CAGGTGCAGCTACAG CAGTGGGG-3' | SEQ ID NO: 137 |
| HuVH4C | 5'-CAGSTGCAGCTGCAG GAGTCSGG-3' | SEQ ID NO: 138 |
| HuVH5B | 5'-GARGTGCAGCTGGTG CAGTCTGG-3' | SEQ ID NO: 139 |
| HuVH6A | 5'-CAGGTACAGCTGCAG CAGTCAGG-3' | SEQ ID NO: 140 |

TABLE 9

Human IgG heavy chain J-region primers (anti-sense).

| Primer name | Primer nucleotide sequence | SEQ ID NO |
| --- | --- | --- |
| HuJH1/2 | 5'-TGAGGAGACGGTGAC CAGGGTGCC-3' | SEQ ID NO: 141 |
| HuJH3 | 5'-TGAAGAGACGGTGAC CATTGTCCC-3' | SEQ ID NO: 142 |
| HuJH4/5 | 5'-TGAGGAGACGGTGAC CAGGGTTCC-3' | SEQ ID NO: 143 |
| HuJH6 | 5'-TGAGGAGACGGTGAC CGTGGTCCC-3' | SEQ ID NO: 144 |

TABLE 10

Human IgG heavy chain variable region primers extended with SfiI/NcoI restriction sites (sense) and human IgG heavy chain J-region primers extended with XhoI/BstEII restriction sites (anti-sense).

| Primer name | Primer nucleotide sequence | SEQ ID NO |
| --- | --- | --- |
| HuVH1B/7A-NcoI | 5'-GTCCTCGCAACTGCGGCCCAGCCGGCCATG GCCCAGRTGCAGCTGGTGCARTCTGG-3' | SEQ ID NO: 145 |
| HuVH1C-NcoI | 5'-GTCCTCGCAACTGCGGCCCAGCCGGCCATG GCCSAGGTCCAGCTGGTRCAG TCTGG-3' | SEQ ID NO: 146 |
| HuVH2B-NcoI | 5'-GTCCTCGCAACTGCGGCCCAGCCGGCCATG GCC CAGRTCACCTTGAAGGAG TCTGG-3' | SEQ ID NO: 147 |
| HuVH3B-NcoI | 5'-GTCCTCGCAACTGCGGCCCAGCCGGCCATG GCCSAGGTGCAGCTGGTGGAGTCTGG-3' | SEQ ID NO: 148 |
| HuVH3C-NcoI | 5'-GTCCTCGCAACTGCGGCCCAGCCGGCCATG GCC GAGGTGCAGCTGGTGGAG WCYGG-3' | SEQ ID NO: 149 |
| HuVH4B-NcoI | 5'-GTCCTCGCAACTGCGGCCCAGCCGGCCATG GCC CAGGTGCAGCTACAGCAG TGGGG-3' | SEQ ID NO: 150 |
| HuVH4C-NcoI | 5'-GTCCTCGCAACTGCGGCCCAGCCGGCCATG GCCCAGSTGCAGCTGCAGGAGTCSGG-3' | SEQ ID NO: 151 |
| HuVH5B-NcoI | 5'-GTCCTCGCAACTGCGGCCCAGCCGGCCATG GCC GARGTGCAGCTGGTGCAG TCTGG-3' | SEQ ID NO: 152 |
| HuVH6A-NcoI | 5'-GTCCTCGCAACTGCGGCCCAGCCGGCCATG GCC CAGGTACAGCTGCAGCAG TCAGG-3' | SEQ ID NO: 153 |
| HuJH1/2-XhoI | 5'-GAGTCATTCTCGACTCGAGACGGTGACCAG GGTGCC-3' | SEQ ID NO: 154 |
| HuJH3-XhoI | 5'-GAGTCATTCTCGACTCGAGACGGTGACCAT TGT CCC-3' | SEQ ID NO: 155 |
| HuJH4/5-XhoI | 5'-GAGTCATTCTCGACTCGAGACGGTGACCAG GGT TCC-3' | SEQ ID NO: 156 |
| HuJH6-XhoI | 5'-GAGTCATTCTCGACTCGA GACGGTGACCGTGGTCCC-3' | SEQ ID NO: 157 |

TABLE 11

Human lambda chain variable region primers (sense).

| Primer name | Primer nucleotide sequence | SEQ ID NO |
|---|---|---|
| HuVλ1A | 5'-CAGTCTGTGCTGACT CAGCCACC-3' | SEQ ID NO: 161 |
| HuVλ1B | 5'-CAGTCTGTGYTGACG CAGCCGCC-3' | SEQ ID NO: 162 |
| HuVλ1C | 5'-CAGTCTGTCGTGACG CAGCCGCC-3' | SEQ ID NO: 163 |
| HuVλ2 | 5'-CARTCTGCCCTGACT CAGCCT-3' | SEQ ID NO: 164 |
| HuVλ3A | 5'-TCCTATGWGCTGACT CAGCCACC-3' | SEQ ID NO: 165 |
| HuVλ3B | 5'-TCTTCTGAGCTGACT CAGGACCC-3' | SEQ ID NO: 166 |
| HuVλ4 | 5'-CACGTTATACTGACT CAACCGCC-3' | SEQ ID NO: 167 |
| HuVλ5 | 5'-CAGGCTGTGCTGACT CAGCCGTC-3' | SEQ ID NO: 168 |
| HuVλ6 | 5'-AATTTTATGCTGACT CAGCCCCA-3' | SEQ ID NO: 169 |
| HuVλ7/8 | 5'-CAGRCTGTGGTGACY CAGGAGCC-3' | SEQ ID NO: 170 |
| HuVλ9 | 5'-CWGCCTGTGCTGACT CAGCCMCC-3' | SEQ ID NO: 171 |

TABLE 12

Human kappa chain variable region primers (sense).

| Primer name | Primer nucleotide sequence | SEQ ID NO |
|---|---|---|
| HuVκ1B | 5'-GACATCCAGWTGACCCAGTCTCC-3' | SEQ ID NO: 172 |
| HuVκ2 | 5'-GATGTTGTGATGACT CAGTCTCC-3' | SEQ ID NO: 173 |
| HuVκ3 | 5'-GAAATTGTGWTGACR CAGTCTCC-3' | SEQ ID NO: 174 |
| HuVκ4 | 5'-GATATTGTGATGACC CACACTCC-3' | SEQ ID NO: 175 |
| HuVκ5 | 5'-GAAACGACACTCACG CAGTCTCC-3' | SEQ ID NO: 176 |
| HuVκ6 | 5'-GAAATTGTGCTGACTCAGTCTCC-3' | SEQ ID NO: 177 |

TABLE 13

Human lambda chain J-region primers (anti-sense).

| Primer name | Primer nucleotide sequence | SEQ ID NO |
|---|---|---|
| HuJλ1 | 5'-ACCTAGGACGGTGACCTTGGTCCC-3' | SEQ ID NO: 178 |
| HuJλ2/3 | 5'-ACCTAGGACGGTCAG CTTGGTCCC-3' | SEQ ID NO: 179 |
| HuJλ4/5 | 5'-ACYTAAAACGGTGAG CTGGGTCCC-3' | SEQ ID NO: 180 |

TABLE 14

Human lambda chain J-region primers (anti-sense).

| Primer name | Primer nucleotide sequence | SEQ ID NO |
|---|---|---|
| HuJκ1 | 5'-ACGTTTGATTTCCAC CTTGGTCCC-3' | SEQ ID NO: 181 |
| HuJκ2 | 5'-ACGTTTGATCTCCAG CTTGGTCCC-3' | SEQ ID NO: 182 |
| HuJκ3 | 5'-ACGTTTGATATCCAC TTTGGTCCC-3' | SEQ ID NO: 183 |

TABLE 14-continued

Human lambda chain J-region primers (anti-sense).

| Primer name | Primer nucleotide sequence | SEQ ID NO |
|---|---|---|
| HuJκ4 | 5'-ACGTTTGATCTCCAC CTTGGTCCC-3' | SEQ ID NO: 184 |
| HuJκ5 | 5'-ACGTTTAATCTCCAG TCGTGTCCC-3' | SEQ ID NO: 185 |

TABLE 15

Human kappa chain variable region primers extended with SalI restriction sites (sense), human kappa chain J-region primers extended with NotI restriction sites (anti-sense), human lambda chain variable region primers extended with SalI restriction sites (sense) and human lambda chain J-region primers extended with NotI restriction sites (anti-sense).

| Primer name | Primer nucleotide sequence | SEQ ID NO |
|---|---|---|
| HuVκ1B-SalI | 5'-TGAGCACACAGGTCGACGGACATCCAGWTG ACCCAGTCTCC-3' | SEQ ID NO: 186 |
| HuVκ2-SalI | 5'-TGAGCACACAGGTCGACGGATGTTGTGATG ACTCAGTCTCC-3' | SEQ ID NO: 187 |
| HuVκ3B-SalI | 5'-TGAGCACACAGGTCGACGGAAATTGTGWTG ACRCAGTCTCC-3' | SEQ ID NO: 188 |
| HuVκ4B-SalI | 5'-TGAGCACACAGGTCGACGGATATTGTGATG ACCCACACTCC-3' | SEQ ID NO: 189 |
| HuVκ5-SalI | 5'-TGAGCACACAGGTCGACGGAAACGACACTC ACGCAGTCTCC-3' | SEQ ID NO: 190 |
| HuVκ6-SalI | 5'-TGAGCACACAGGTCGACGGAAATTGTGCTG ACTCAGTCTCC-3' | SEQ ID NO: 191 |
| HuJκ1-NotI | 5'-GAGTCATTCTCGACTTGCGGCCGCACGTTTG ATTTCCACCTTGGTCCC-3' | SEQ ID NO: 192 |
| HuJκ2-NotI | 5'-GAGTCATTCTCGACTTGCGGCCGCACGTTTG ATCTCCAGCTTGGTCCC-3' | SEQ ID NO: 193 |
| HuJκ3-NotI | 5'-GAGTCATTCTCGACTTGCGGCCGCACGTTTG ATATCCACTTTGGTCCC-3' | SEQ ID NO: 194 |
| HuJκ4-NotI | 5'-GAGTCATTCTCGACTTGCGGCCGCACGTTTG ATCTCCACCTTGGTCCC-3' | SEQ ID NO: 195 |
| HuJκ5-NotI | 5'-GAGTCATTCTCGACTTGCGGCCGCACGTTTA ATCTCCAGTCGTGTCCC-3' | SEQ ID NO: 196 |
| HuVλ1A-SalI | 5'-TGAGCACACAGGTCGACGCAGTCTGTGCTGA CTCAGCCACC-3' | SEQ ID NO: 197 |
| HuVλ1B-SalI | 5'-TGAGCACACAGGTCGACGCAGTCTGTGYTG ACGCAGCCGCC-3' | SEQ ID NO: 198 |
| HuVλ1C-SalI | 5'-TGAGCACACAGGTCGACGCAGTCTGTCGTGA CGCAGCCGCC-3' | SEQ ID NO: 199 |
| HuVλ2-SalI | 5'-TGAGCACACAGGTCGACGCARTCTGCCCTGA CTCAGCCT-3' | SEQ ID NO: 200 |
| HuVλ3A-SalI | 5'-TGAGCACACAGGTCGACGTCCTATGWGCTG ACTCAGCCACC-3' | SEQ ID NO: 201 |
| HuVλ3B-SalI | 5'-TGAGCACACAGGTCGACGTCTTCTGAGCTGA CTCAGGACCC-3' | SEQ ID NO: 202 |

TABLE 15-continued

Human kappa chain variable region primers extended with SalI restriction sites (sense), human kappa chain J-region primers extended with NotI restriction sites (anti-sense), human lambda chain variable region primers extended with SalI restriction sites (sense) and human lambda chain J-region primers extended with NotI restriction sites (anti-sense).

| Primer name | Primer nucleotide sequence | SEQ ID NO |
|---|---|---|
| HuVλ4-SalI | 5'-TGAGCACACAGGTCGACGCACGTTATACTGA CTCAACCGCC-3' | SEQ ID NO: 203 |
| HuVλ5-SalI | 5'-TGAGCACACAGGTCGACGCAGGCTGTGCTG ACTCAGCCGTC-3' | SEQ ID NO: 204 |
| HuVλ6-SalI | 5'-TGAGCACACAGGTCGACGAATTTTATGCTGA CTCAGCCCCA-3' | SEQ ID NO: 205 |
| HuVλ7/8-SalI | 5'-TGAGCACACAGGTCGACGCAGRCTGTGGT GACYCAGGAGCC-3' | SEQ ID NO: 206 |
| HuVλ9-SalI | 5'-TGAGCACACAGGTCGACGCWGCCTGTGCTG ACTCAGCCMCC-3' | SEQ ID NO: 207 |
| HuJλ1-NotI | 5'-GAGTCATTCTCGACTTGCGGCCGCACCTAGG ACGGTGACCTTGGTCCC-3' | SEQ ID NO: 208 |
| HuJλ2/3-NotI | 5'-GAGTCATTCTCGACTTGCGGCCGCACCTAG GACGGTCAGCTTGGTCCC-3' | SEQ ID NO: 209 |
| HuJλ4/5-NotI | 5'-GAGTCATTCTCGACTTGCGGCCGCACYTAA AACGGTGAGCTGGGTCCC-3' | SEQ ID NO: 210 |

TABLE 16

Distribution of the different light chain products over the 10 fractions.

| Light chain products | Number of alleles | Fraction number | alleles/fraction |
|---|---|---|---|
| Vk1B/Jk1-5 | 19 | 1 and 2 | 9.5 |
| Vk2/Jk1-5 | 9 | 3 | 9 |
| Vk3B/Jk1-5 | 7 | 4 | 7 |
| Vk4B/Jk1-5 | 1 | 5 | 5 |
| Vk5/Jk1-5 | 1 | | |
| Vk6/Jk1-5 | 3 | | |
| Vλ1A/Jl1-3 | 5 | 6 | 5 |
| Vλ1B/Jl1-3 | | | |
| Vλ1C/Jl1-3 | | | |
| Vλ2/Jl1-3 | 5 | 7 | 5 |
| Vλ3A/Jl1-3 | 9 | 8 | 9 |
| Vλ3B/Jl1-3 | | | |
| Vλ4/Jl1-3 | 3 | 9 | 5 |
| Vλ5/Jl1-3 | 1 | | |
| Vλ6/Jl1-3 | 1 | | |
| Vλ7/8/Jl1-3 | 3 | 10 | 6 |
| Vλ9/Jl1-3 | 3 | | |

TABLE 17

Binding of single-chain (scFv) phage antibodies selected from a naïve or an immune phage display library to a SARS-CoV preparation (Frankfurt 1 strain).

| Name phage antibody | SARS-CoV preparation (OD492 nm) | Number of ELISA plate |
|---|---|---|
| sc03-019 | 0.333 | 1 |
| sc03-020 | 0.671 | 2 |
| sc03-021 | 0.215 | 2 |
| sc03-022 | 1.18 | 2 |
| sc03-023 | 1.311 | 2 |
| sc03-024 | 0.235 | 2 |
| sc03-025 | 1.636 | 2 |
| sc03-026 | 1.071 | 2 |
| sc03-027 | 1.163 | 2 |
| sc03-029 | 0.629 | 4 |
| sc03-030 | 1.15 | 3 |
| sc03-031 | 0.635 | 4 |
| sc03-032 | 1.219 | 3 |
| sc03-033 | 0.288 | 4 |
| sc03-034 | 0.802 | 3 |
| sc03-035 | 0.596 | 3 |
| sc03-036 | 0.24 | 3 |
| sc03-037 | 0.287 | 4 |
| sc03-038 | 0.314 | 4 |
| sc03-039 | 0.851 | 3 |
| sc03-040 | 0.616 | 4 |
| sc03-041 | 0.861 | 4 |
| sc03-042 | 0.645 | 4 |
| sc03-043 | 1.271 | 3 |
| sc03-044 | 0.518 | 4 |
| sc03-045 | 0.577 | 4 |
| sc03-046 | 1.897 | 3 |

TABLE 17-continued

Binding of single-chain (scFv) phage antibodies selected from a naïve or an immune phage display library to a SARS-CoV preparation (Frankfurt 1 strain).

| Name phage antibody | SARS-CoV preparation (OD492 nm) | Number of ELISA plate |
|---|---|---|
| sc03-047 | 0.866 | 4 |
| sc03-048 | 0.397 | 3 |
| sc03-049 | 1.006 | 3 |
| sc03-050 | 1.184 | 3 |
| sc03-051 | 0.602 | 3 |
| sc03-052 | 0.355 | 4 |
| sc03-053 | 0.218 | 3 |
| sc03-054 | 0.428 | 4 |
| sc03-055 | 0.608 | 3 |
| sc03-056 | 0.924 | 3 |
| sc03-057 | 1.19 | 3 |
| sc03-058 | 0.355 | 4 |
| sc03-059 | 0.293 | 1 | plate 1: SARS-CoV preparation (OD492 nm) for no single chain phage antibody was 0.060.
plate 2: SARS-CoV preparation (OD492 nm) for no single chain phage antibody was 0.211.
plate 3: SARS-CoV preparation (OD492 nm) for no single chain phage antibody was 0.054.
plate 4: SARS-CoV preparation (OD492 nm) for no single chain phage antibody was 0.051.

TABLE 18

Data of the single-chain Fvs capable of binding SARS-CoV and obtained from a naïve and an immune phage display library.

| Name scFv | SEQ ID NO of nucleotide sequence | SEQ ID NO of amino acid sequence | HCDR3 | $V_H$-germline | $V_l$-germline |
|---|---|---|---|---|---|
| sc03-019 | 211 | 212 | FPGGTRSRGYMDV (SEQ ID NO: 291) | $V_H$3-30.3 (DP-46) | $V_K$III (L6) |
| sc03-020 | 213 | 214 | GSGISTPMDV (SEQ ID NO: 292) | $V_H$5-51 (DP-73) | $V_K$IV (B3-DPK24) |
| sc03-021 | 215 | 216 | GSGISTPMDV (SEQ ID NO: 292) | $V_H$5-51 (DP-73) | $V_K$IV (B3-DPK24) |
| sc03-022 | 217 | 218 | GSGISTPMDV (SEQ ID NO: 292) | $V_H$5-51 (DP-73) | $V_K$IV (B3-DPK24) |
| sc03-023 | 219 | 220 | RVEVVEYQLLRPR YKSWFDP (SEQ ID NO: 293) | $V_H$4-34 (DP-63) | $V_L$II (2a2-V1-04) |
| sc03-024 | 221 | 222 | KSAGSNAFDI (SEQ ID NO: 294) | $V_H$7-04.1 (DP-21) | $V_L$1 (1b-V1-19) |
| sc03-025 | 223 | 224 | TTNRAFDI (SEQ ID NO: 295) | $V_H$3-64 | VKIV (B3-DPK24) |
| sc03-026 | 225 | 226 | TTNRAFDI (SEQ ID NO: 295) | $V_H$3-64 | $V_K$IV (B3-DPK24) |
| sc03-027 | 227 | 228 | TTNRAFDI (SEQ ID NO: 295) | $V_H$3-64 | $V_K$IV (B3-DPK24) |
| sc03-029 | 229 | 230 | TTNRAFDI (SEQ ID NO: 295) | $V_H$3-64 | $V_K$IV (B3-DPK24) |
| sc03-030 | 231 | 232 | TTNRAFDI (SEQ ID NO: 295) | $V_H$3-64 | $V_K$IV (B3-DPK24) |
| sc03-031 | 233 | 234 | ESGGGYDNHFDY (SEQ ID NO: 296) | $V_H$1-69 (DP-10) | $V_L$1 (1c-V1-16) |
| sc03-032 | 235 | 236 | DGWDLTGSFLGYG MDV (SEQ ID NO: 297) | $V_H$1-e (DP-88) | $V_L$1 (1c-V1-16) |
| sc03-033 | 237 | 238 | GSGISTPMDV (SEQ ID NO: 292) | $V_H$5-51 (DP-73) | $V_K$IV (B3-DPK24) |
| sc03-034 | 239 | 240 | GSGISTPMDV (SEQ ID NO: 292) | $V_H$5-51 (DP-73) | $V_K$IV (B3-DPK24) |

TABLE 18-continued

Data of the single-chain Fvs capable of binding
SARS-CoV and obtained from a naïve
and an immune phage display library.

| Name scFv | SEQ ID NO of nucleotide sequence | SEQ ID NO of amino acid sequence | HCDR3 | $V_H$-germline | $V_l$-germline |
|---|---|---|---|---|---|
| sc03-035 | 241 | 242 | GSGISTPMDV (SEQ ID NO: 292) | $V_H$5-51 (DP-73) | $V_K$IV (B3-DPK24) |
| sc03-036 | 243 | 244 | GSGISTPMDV (SEQ ID NO: 292) | $V_H$5-51 (DP-73) | $V_K$IV (B3-DPK24) |
| sc03-037 | 245 | 246 | DAHRGFGMDV (SEQ ID NO: 298) | $V_H$3-53 (DP-42) | $V_L$3 (31-V2-13) |
| sc03-038 | 247 | 248 | DAHRGFGMDV (SEQ ID NO: 298) | $V_H$3-53 (DP-42) | $V_L$3 (31-V2-13) |
| sc03-039 | 249 | 250 | GSKWNDVGGGDY (SEQ ID NO: 299) | $V_H$3-23 (DP-47) | $V_L$6 (6A-V1-22) |
| sc03-040 | 251 | 252 | TTNRAFDI (SEQ ID NO: 295) | $V_H$3-64 | $V_K$IV (B3-DPK24) |
| sc03-041 | 253 | 254 | TTNRAFDI (SEQ ID NO: 295) | $V_H$3-64 | $V_K$IV (B3-DPK24) |
| sc03-042 | 255 | 256 | TTNRAFDI (SEQ ID NO: 295) | $V_H$3-64 | $V_K$IV (B3-DPK24) |
| sc03-043 | 257 | 258 | TTNRAFDI (SEQ ID NO: 295) | $V_H$3-64 | $V_K$IV (B3-DPK24) |
| sc03-044 | 259 | 260 | TTNRAFDI (SEQ ID NO: 295) | $V_H$3-64 | $V_K$IV (B3-DPK24) |
| sc03-045 | 261 | 262 | TTNRAFDI (SEQ ID NO: 295) | $V_H$3-64 | $V_K$IV (B3-DPK24) |
| sc03-046 | 263 | 264 | TTNRAFDI (SEQ ID NO: 295) | $V_H$3-64 | $V_K$IV (B3-DPK24) |
| sc03-047 | 265 | 266 | TTNRAFDI (SEQ ID NO: 295) | $V_H$3-64 | $V_K$IV (B3-DPK24) |
| sc03-048 | 267 | 268 | TTNRAFDI (SEQ ID NO: 295) | $V_H$3-64 | $V_K$IV (B3-DPK24) |
| sc03-049 | 269 | 270 | TTNRAFDI (SEQ ID NO: 295) | $V_H$3-64 | $V_K$IV (B3-DPK24) |
| sc03-050 | 271 | 272 | TTNRAFDI (SEQ ID NO: 295) | $V_H$3-64 | $V_K$IV (B3-DPK24) |
| sc03-051 | 273 | 274 | GSGISTPMDV (SEQ ID NO: 292) | $V_H$5-51 (DP-73) | $V_K$IV (B3-DPK24) |
| sc03-052 | 275 | 276 | GSGISTPMDV (SEQ ID NO: 292) | $V_H$5-51 (DP-73) | $V_K$IV (B3-DPK24) |
| sc03-053 | 277 | 278 | GTGYLRSYHGMDV (SEQ ID NO: 300) | $V_H$1-03 (DP-25) | $V_K$II (A19/A03-DPK15) |
| sc03-054 | 279 | 280 | TTNRAFDI (SEQ ID NO: 295) | $V_H$3-64 | $V_K$IV (B3-DPK24) |
| sc03-055 | 281 | 282 | RVEVVEYQLLRPRYKSWFDP (SEQ ID NO: 293) | $V_H$4-34 (DP-63) | $V_L$1 (1b-V1-19) |
| sc03-056 | 283 | 284 | GSGISTPMDV (SEQ ID NO: 292) | $V_H$5-51 (DP-73) | $V_K$IV (B3-DPK24) |
| sc03-057 | 285 | 286 | PDIVVAGHSPPHYTMDV (SEQ ID NO: 301) | $V_H$1-69 (DP-10) | $V_K$I L11-DPK3 |

TABLE 18-continued

Data of the single-chain Fvs capable of binding SARS-CoV and obtained from a naïve and an immune phage display library.

| Name scFv | SEQ ID NO of nucleotide sequence | SEQ ID NO of amino acid sequence | HCDR3 | $V_H$-germline | $V_l$-germline |
|---|---|---|---|---|---|
| sc03-058 | 287 | 288 | TTNRAFDI (SEQ ID NO: 295) | $V_H$3-64 | $V_K$VI A14-DPK25 |
| sc03-059 | 289 | 290 | FPGGTRSRGYMDV (SEQ ID NO: 291) | $V_H$1-46 (DP-7) | $V_K$III (L6) |

TABLE 19

Scheme of the in vivo ferret experiment.

| Group | Animals/group | Challenge (intratracheal)[a] | Split[b] | Sampling (days)[c] | | | | | | |
|---|---|---|---|---|---|---|---|---|---|---|
| | | | | 0 | 1 | 2 | 3 | 4 | 5 | 6 | 7 |
| 1 | 4 | 1,000 (TCID$_{50}$/ml) | 03-014Ab | 2 2 | S S | S S | | S + LT S | | | S + LT |
| 2 | 4 | 10,000 (TCID$_{50}$/ml) | | 2 2 | S S | S S | | S + LT S | | | S + LT |
| 3 | 4 | 1,000 (TCID$_{50}$/ml) | Contr Ab | 2 2 | S S | S S | | S + LT S | | | S + LT |
| 4 | 4 | 10,000 (TCID$_{50}$/ml) | | 2 2 | S S | S S | | S + LT S | | | S + LT |

[a] premix of challenge dose and optimal concentration antibody
[b] split based on sacrification
[c] S means swabs; LT means lung tissue after sacrification

TABLE 20

Scheme for tissue and fluid sampling

| Group | No/Group | Challenge/mAb | | Sampling (days) | | | | |
|---|---|---|---|---|---|---|---|---|
| | | | | −1 | 0 | 1 | 2 | 3 | 4 |
| I | 4 | 1x10E4 TCID$_{50}$ | ContrAb | B* | B, S | | S | | S, LT |
| II | 4 | 1x10E4 TCID$_{50}$ | 03-014 | B | B, S | | S | | S, LT |

*B, blood;
S, pharyngeal swab,
LT, lung tissue to be processed for virus titration and pathology

TABLE 21

List of SARS-CoV strains having a region 318-510 of the S protein not identical to the region 318-510 of the S protein of SARS-CoV Frankfurt 1 strain.

| Mutation | Strain | Genbank |
|---|---|---|
| K344R | GZ02 | AY390556 |
| | GZ60 | AY304491 |
| | JMD | AY394988 |
| | ZS-B | AY394996 |
| | GZ43 | AY304490 |
| | HGZ8L1-A | AY394981 |
| | ZS-A | AY394997 |
| | ZS-C | AY395003 |
| K344R F501Y | GD01 | AY278489 |
| K344R F360S L472P D480G | GD03T0013 | AY525636 |
| T487S | | |
| S353F | Sin3408 | AY559083 |
| | Sin3765V | AY559084 |
| | Sin845 | AY559093 |
| | Sin847 | AY559095 |
| | Sin849 | AY559086 |
| | Sin852 | AY559082 |
| | Sin3725V | AY559087 |
| | Sin842 | AY559081 |
| | Sin846 | AY559094 |
| | Sin848 | AY559085 |
| | Sin850 | AY559096 |
| R426G N437D | Shanghai LY | AY322205S3 |

TABLE 21-continued

List of SARS-CoV strains having a region 318-510 of the S protein not identical to the region 318-510 of the S protein of SARS-CoV Frankfurt 1 strain.

| Mutation | Strain | Genbank |
|---|---|---|
| Y436H | GZ-C | AY394979 |
| Y442S | Sino1-11 | AY485277 |
| N479S | BJ302 cl. 2 | AY429073 |
|  | BJ302 cl. 4 | AY429075 |
|  | BJ302 cl. 6 | AY429077 |
|  | BJ302 cl. 3 | AY429074 |
|  | BJ302 cl. 5 | AY429076 |
|  | BJ302 cl. 8 | AY429079 |

The amino acid substitutions compared to the Frankfurt 1 S protein are indicated in the left column. Strain and GenBank accession number are indicated in second and third column.

TABLE 22

Concentrations of the monoclonal anti-SARS-CoV antibody 03-014 giving complete protection against 100 TCID50 of the different SARS-CoV isolates indicated in an in vitro neutralization assay.

| SARS-CoV Strain* | Concentration of 03-014 (µg/ml) resulting in 100% protection against 100 TCID50 |
|---|---|
| 36 (3) | 12.5 |
| 39849 (3) | 12.5 |
| 66 (2) | 12.5 |
| 61567 (2) | 12.5 |
| 61644 (1) | 12.5 |
| 61644 (15) | 12.5 |

*Between brackets the passage numbers of the respective strains is indicated

REFERENCES

Boel E., S. Verlaan, M. J. Poppelier, N. A. Westerdaal, J. A. Van Strijp and T. Logtenberg (2000), Functional human monoclonal antibodies of all isotypes constructed from phage display library-derived single-chain Fv antibody fragments. J. Immunol. Methods 239:153-166.

Burton D. R. and C. F. Barbas (1994), Human antibodies from combinatorial libraries. Adv. Immunol. 57:191-280.

De Kruif J., L. Terstappen, E. Boel and T. Logtenberg (1995a), Rapid selection of cell subpopulation-specific human monoclonal antibodies from a synthetic phage antibody library. Proc. Natl. Acad. Sci. USA 92:3938.

De Kruif J., E. Boel and T. Logtenberg (1995b), Selection and application of human single-chain Fv antibody fragments from a semi-synthetic phage antibody display library with designed CDR3 regions. J. Mol. Biol. 248:97-105.

Emini E. A., P. L. Nara, W. A. Schleif, J. A. Lewis, J. P. Davide, D. R. Lee, J. Kessler, S. Conley, S. Matsushita, S. D. J. Putney, R. J. Gerety and J. W. Eichberg, Antibody-mediated in vitro neutralization of human immunodeficiency virus type 1 abolishes infectivity for chimpanzees. J. Virol. 64:3674-3678.

Fouchier R. A., T. Kuiken, M. Schutten, G. van Amerongen, G. J. van Doornum, B. G. van den Hoogen, M. Peiris, W. Lim, K. Stohr, A. D. Osterhaus (2003), Koch's postulates fulfilled for SARS virus. Nature 243:240.

Havenga M. J., A. A. Lemckert, J. M. Grimbergen, R. Vogels, L. G. Huisman, D. Valerio, A. Bout and P. H. Quax (2001), Improved adenovirus vectors for infection of cardiovascular tissues. J. Virol. 75:3335-3342.

Holmes K. V. (2003), SARS coronavirus: a new challenge for prevention and therapy. J. Clin. Invest. 111, 1605-1609.

Huls G., I. J. Heijnen, E. Cuomo, J. van der Linden, E. Boel, J. van de Winkel and T. Logtenberg (1999), Antitumor immune effector mechanisms recruited by phage display-derived fully human IgG1 and IgA1 monoclonal antibodies. Cancer Res. 59:5778-5784.

Ksiazek T. G., D. Erdman, C. S. Goldsmith, S. R. Zaki, T. Peret, S. Emery, S. Tong, C. Urbani, J. A. Comer, W. Lim, P. E. Rollin, S. F. Dowell, A. E. Ling, C. D. Humphrey, W. J. Shieh, J. Guarner, C. D. Paddock, P. Rota, B. Fields, J. DeRisi, J. Y. Yang, N. Cox, J. M. Hughes, J. W. LeDuc, W. J. Bellini, L. J. Anderson (2003), A novel coronavirus associated with severe acute respiratory syndrome. N. Eng. J. Med. 348:1953-1966.

Kuiken T., R. A. Fouchier, M. Schutten, G. F. Rimmelzwaan, G. van Amerongen, D. van Riel, J. D. Laman, T. de Jong, G. van Doornum, W. Lim, A. E. Ling, P. K. Chan, J. S. Tam, M. C. Zambon, R. Gopal, C. Drosten, S. van der Werf, N. Escriou, J. C. Manuguerra, K. Stohr, J. S. Peiris and A. D. Osterhaus (2003), Newly discovered coronavirus as the primary cause of severe acute respiratory syndrome. Lancet 362:263-270.

Li W., M. J. Moore, N. Vasilieva, J. Sui, S. K. Wong, M. A. Berne, M. Somasundaran, J. L. Sullivan, K. Luzuriaga, T. C. Greenough, H. Choe and M. Farzan (2003), Angiotensin-converting enzyme 2 is a functional receptor for the SARS coronavirus. Nature 2003 426:450-454.

Marra M. A., S. J. Jones, C. R. Astell, R. A. Holt, A. Brooks-Wilson, Y. S. Butterfield, J. Khattra, J. K. Asano, S. A. Barber, S. Y. Chan, A. Cloutier, S. M. Coughlin, D. Freeman, N. Girn, O. L. Griffith, S. R. Leach, M. Mayo, H. McDonald, S. B. Montgomery, P. K. Pandoh, A. S. Petrescu, A. G. Robertson, J. E. Schein, A. Siddiqui, D. E. Smailus, J. M. Stott, G. S. Yang, F. Plummer, A. Andonov, H. Artsob, N. Bastien, K. Bernard, T. F. Booth, D. Bowness, M. Czub, M. Drebot, L. Fernando, R. Flick, M. Garbutt, M. Gray, A. Grolla, S. Jones, H. Feldmann, A. Meyers, A. Kabani, Y. Li, S. Normand, U. Stroher, G. A. Tipples, S. Tyler, R. Vogrig, D. Ward, B. Watson, R. C. Brunham, M. Krajden, M. Petric, D. M. Skowronski, C. Upton, R. L. Roper (2003), The genome sequence of the SARS-associated coronavirus. Science 300, 1399-1404.

Rickerts V., T. Wolf, C. Rottmann, W. Preiser, C. Drosten, V. Jakobi, H. H. Leong, H. R. Brodt (2003), Klinik und Behandlung des schweren akuten respiratorischen Syndroms. Dtsch. Med. Wochenschrift 128:1109-1114.

Rota P. A., M. S. Oberste, S. S. Monroe, W. A. Nix, R. Campagnoli, J. P. Icenogle, S. Penaranda, B. Bankamp, K. Maher, M. H. Chen, S. Tong, A. Tamin, L. Lowe, M. Frace, J. L. DeRisi, Q. Chen, D. Wang, D. D. Erdman, T. C. Peret, C. Burns, T. G. Ksiazek, P. E. Rollin, A. Sanchez, S. Liffick, B. Holloway, J. Limor, K. McCaustland, M. Olsen-Rasmussen, R. Fouchier, S. Gunther, A. D. Osterhaus, C. Drosten, M. A. Pallansch, L. J. Anderson, W. J. Bellini (2003), Characterization of a novel coronavirus associated with severe acute respiratory syndrome. Science 300, 1394-1399.

Slootstra J. W., W. C. Puijk, G. J. Ligtvoet, J. P. Langeveld, R. H. Meloen (1996), Structural aspects of antibody-antigen interaction revealed through small random peptide libraries. Mol. Divers. 1, 87-96.

Ter Meulen J., A. B. H. Bakker, E. N. van den Brink, G. J. Weverling, B. E. E. Martina, B. L. Haagmans, T. Kuiken, J. de Kruif, W. Preiser, W. Spaan, H. R. Gelderblom, J. Goudsmit, A. D. M. E. Osterhaus (2004), Human monoclonal antibody as prophylaxis for SARS coronavirus infection in ferrets. The Lancet 363, 2139-2141.

SEQUENCE LISTING (484 sequences)

SEQ ID NO: 1 - protein, 9 aa, Artificial sequence
  HCDR3 of SC03-001
HRFRHVFDY

SEQ ID NO: 2 - protein, 11 aa, Artificial sequence
  HCDR3 of SC03-002
YYSRSLKAFDY

SEQ ID NO: 3 - protein, 9 aa, Artificial sequence
  HCDR3 of SC03-003
RSYFRRFDY

SEQ ID NO: 4 - protein, 11 aa, Artificial sequence
  HCDR3 of SC03-005
GGGRPYNPFDY

SEQ ID NO: 5 - protein, 11 aa, Artificial sequence
  HCDR3 of SC03-006
DGSPRTPSFDY

SEQ ID NO: 6 - protein, 11 aa, Artificial sequence
  HCDR3 of SC03-007
GYWTSLTGFDY

SEQ ID NO: 7 - protein, 9 aa, Artificial sequence
  HCDR3 of SC03-008
RVRPRRFDY

SEQ ID NO: 8 - protein, 12 aa, Artificial sequence
  HCDR3 of SC03-009
GLFMVTTYAFDY

SEQ ID NO: 9 - protein, 11 aa, Artificial sequence
  HCDR3 of SC03-010
GGGLPYLSFDY

SEQ ID NO: 10 - protein, 9 aa, Artificial sequence
  HCDR3 of SC03-012
MFRKSSFDS

SEQ ID NO: 11 - protein, 9 aa, Artificial sequence
  HCDR3 of SC03-013
GLTPLYFDY

SEQ ID NO: 12 - protein, 9 aa, Artificial sequence
  HCDR3 of SC03-014
GISPFYFDY

SEQ ID NO: 13 - protein, 6 aa, Artificial sequence
  HCDR3 of SC03-015
GLSLRP

SEQ ID NO: 14 - DNA, 354 bp, Artificial sequence
  CDS (1)..(354): Variable heavu chain of SC03-001
atggctgaggtgcagctggtggagtctgggggaggcttggtaaagcctggggggtccctgagactctcctgtgcagcctctggattcaccttcagcggctactcgatgaactgggtccgccaggcgcccgggaaggggctggagtgggtctcatccattagtggtggtagcacatactacgcagactccaggaagggcagattcaccatctccagagacaattccaagaacacgctgtatcttcagatgaacaacctgagagctgaggacacggctgtgtattactgtgcaagacaccggttccggcacgtcttcgattactggggccagggcaccctggtgaccgtgctcgag

SEQ ID NO: 15 - protein, 118 aa, Artificial sequence
  Variable heavy chain of SC03-001
MAEVQLVESGGGLVKPGGSLRLSCAASGFTFSGYSMNWVRQAPGKGLEWVSSISGGSTYYADSRKGRFTISRDNSKNTLYLQMNNLRAEDTAVYYCARHRFRHVFDYWGQGTLVTVLE

SEQ ID NO: 16 - DNA, 372 bp, Artificial sequence
  CDS (1)..(372): Variable heavy chain of SC03-002
atggctgaggtgcagctggtggagtctgggggaggcctggtcaagcctggggggtccctgagactctcctgtgcagcctctggattcaccttcagcggctacagcatgagctgggtccgccaggcgcccgggaaggggctggagtgggttggccgtactagaaacaaagctaacagttacaccacagaatacgccgcgtctgtgaaaggcagattcaccatctcaagagatgattcaaagaactcactgtatctgcaaatgaacagcctgaaaaccgaggacacggccgtgtattactgtgctagatactactcccgctccctcaaggccttcgattactggggccagggcaccctggtgaccgtgctcgag

SEQ ID NO: 17 - protein, 124 aa, Artificial sequence
  Variable heavy chain of SC03-002
MAEVQLVESGGGLVKPGGSLRLSCAASGFTFSGYSMSWVRQAPGKGLEWVGRTRNKANSYTTEYAASVKGRFTISRDDSKNSLYLQMNSLKTEDTAVYYCARYYSRSLKAFDYWGQGTLVTVLE

SEQ ID NO: 18 - DNA, 360 bp, Artificial sequence
  CDS (1)..(360): Variable heavy chain of SC03-003
atggctgaggtgcagctggtggagtctgggggaggcttggtccagcctggagggtccctgagactctcctgtgcagcctctggattcaccttcagcagctacccgatgaactgggtccgccaggcgcccgggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtgtattactgtgccagacgcagctacttccgccgcttcgattactggggccagggcaccctggtgaccgtgctcgag

SEQ ID NO: 19 - protein, 120 aa, Artificial sequence
  Variable heavy chain of SC03-003
MAEVQLVESGGGLVQPGGSLRLSCAASGFTFSSYPMNWVRQAPGKGLEWVSAISGSGGSTYYADSVKGRFTISRDNSKNTLYLQMNSLRAEDTAVYYCARRSYFRRFDYWGQGTLVTVLE

SEQ ID NO: 20 - DNA, 360 bp, Artificial sequence
  CDS (1)..(360): Variable heavy chain of SC03-005
atggctgaggtgcagctggtggagtctgggggaggcttgatccagcctggggggtccctgagactctcctgtgcagcctctggattcaccttcagcggctacactatgagctgggtccgccaggcgcccgggcaggggctggagtgggtctcatccattagtggtggtagcacatactacgcagactccaggaagggcagattcaccatctccagagacaattccaagaacacgctgtatcttcaaatgaacaacctgagagctgaggacacggccgtgtattactgtgcaaaaggcggcggccgcccgtacaaccccttcgattactggggccagggcaccctggtgaccgtgctcgag

SEQ ID NO: 21 - protein, 120 aa, Artificial sequence
  Variable heavy chain of SC03-005
MAEVQLVESGGGLIQPGGSLRLSCAASGFTFSGYTMSWVRQAPGQGLEWVSSISGGSTYYADSRKGRFTISRDNSKNTLYLQMNNLRAEDTAVYYCAKGGGRPYNPFDYWGQGTLVTVLE

SEQ ID NO: 22 - DNA, 366 bp, Artificial sequence
  CDS (1)..(366): Variable heavy chain of SC03-006
atggctgaggtgcagctggtggagtctgggggaggcttggtacagcctggggggtccctgagactctcctgtgcagcctctggattcaccttcagcggctaccctatgcactgggtccgccaggcgcccgggaaggggctggagtgggtggcagttatatcatatgacggaagtaataaatactatgcagactccgtgaagggccgattcaccatctccagagacaattccaagaacacgctgtatctgcaaatgaacagcctgagagctgaggacacagctgtgtattactgtgctaaagacggcagcccccgcacccccagcttcgattactggggccagggcaccctggtgaccgtgctcgag

SEQ ID NO: 23 - protein, 122 aa, Artificial sequence
  Variable heavy chain of SC03-006
MAEVQLVESGGGLVQPGGSLRLSCAASGFTFSGYPMHWVRQAPGKGLEWVAVISYDGSNKYYADSVKGRFTISRDNSKNTLYLQMNSLRAEDTAVYYCAKDGSPRTPSFDYWGQGTLVTVLE

SEQ ID NO: 24 - DNA, 366 bp, Artificial sequence
  CDS (1)..(366): Variable heavy chain of SC03-007
atggctgaggtgcagctggtggagtctgggggaggcttggtacagcctagggggtccctgagactctcctgtgcagcctctggattcaccttcagcgactaccggatgaactgggtccgccaggcgcccgggaaggggctggagagggtggcagttatatcatatgatggaagcaataaatactacgcagactccgtgaagggccgattcaccatctccagagacaattccaagaacacgctgtatctgcaaatgaacagcctgagagctgaggacacagccgtgtattactgtgcaagaggctactggacgtcgctcacgggcttcgattactggggccagggcaccctggtgaccgtgctcgag

SEQ ID NO: 25 - protein, 122 aa, Artificial sequence
  Variable heavy chain of SC03-007
MAEVQLVESGGGLVQPRGSLRLSCAASGFTFSDYRMNWVRQAPGKGLERVAVISYDGSNKYYADSVKGRFTISRDNSKNTLYLQMNSLRAEDTAVYYCARGYWTSLTGFDYWGQGTLVTVLE

SEQ ID NO: 26 - DNA, 360 bp, Artificial sequence
  CDS (1)..(360): Variable heavy chain of SC03-008
atggctgaggtgcagctggtggagtctgggggaggcgtggtccagcctgggaggtccctgagactctcctgtgcagcctctggattcaccttcagcagctacccgatgaactgggtccgccaggcgcccgggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacagccgtgtattactgtgcaagacgcgtccgcccccgccgcttcgattattggggccagggcaccctggtgaccgtgctcgag

SEQ ID NO: 27 - protein, 120 aa, Artificial sequence
  Variable heavy chain of SC03-008
MAEVQLVESGGGVVQPGRSLRLSCAASGFTFSSYPMNWVRQAPGKGLEWVSAISGSGGSTYYADSVKGRFTISRDNSKNTLYLQMNSLRAEDTAVYYCARRVRPRRFDYWGQGTLVTVLE

SEQ ID NO: 28 - DNA, 369 bp, Artificial sequence
  CDS (1)..(369): Variable heavy chain of SC03-009
atggctgaggtgcagctggtggagtctgggggaggcgtggtccagcctgggaggtccctgagactctcctgtgcagcctctggattcacctttagcgactaccccatgaactgggtccgccaggcgcccgggaaggggctggagtgggtctcatccattagtggtagtggtggtagcacatactacgcagactccgtgaagggccggttcaccatctccagagacaattccaagaacacgctgtatctgcaaatgaacagcctgagagccgaggacacagccgtgtattactgtgcaaaaggcctcttcatggtcaccacgtacgcgttcgattactggggccagggcaccctggtgaccgtgctcgag

SEQ ID NO: 29 - protein, 123 aa, Artificial sequence
  Variable heavy chain of SC03-009
MAEVQLVESGGGVVQPGRSLRLSCAASGFTFSDYPMNWVRQAPGKGLEWVSSISGSGGSTYYADSVKGRFTISRDNSKNTLYLQMNSLRAEDTAVYYCAKGLFMVTTYAFDYWGQGTLVTVLE

SEQ ID NO: 30 - DNA, 360 bp, Artificial sequence
  CDS (1)..(360): Variable heavy chain of SC03-010
atggctgaggtgcagctggtggagtctgggggaggcgtggtccagcctgggaggtccctgagactctcctgtgcaacctctggattcaccttcagcggctacacgatgcactgggtccgccaggcgcccgggaaggggctggagtgggtctcatccattagtggtggtagcacatactacgcagactccaggaagggcagattcaccatctccagagacaactccaagaacacgctgtatcttcaaatgaacaacctgagagctgaggacacagctgtgtattactgtgcaaaaggcggcggcctcccctacttgagcttcgattactggggccagggcaccctggtgaccgtgctcgag

SEQ ID NO: 31 - protein, 120 aa, Artificial sequence
  Variable heavy chain of SC03-010
MAEVQLVESGGGVVQPGRSLRLSCATSGFTFSGYTMHWVRQAPGKGLEWVSSISGGSTYYADSRKGRFTISRDNSKNTLYLQMNNLRAEDTAVYYCAKGGGLPYLSFDYWGQGTLVTVLE

SEQ ID NO: 32 - DNA, 360 bp, Artificial sequence
  CDS (1)..(360): Variable heavy chain of SC03-012
atggcccaggtgcagctggtgcagtctggggctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgagcagcctgagatctgacgacacggccgtgtattactgtgcaaggatgtttaggaagagttcctttgactcctggggccaaggtaccctggtcaccgtctcgaga

SEQ ID NO: 33 - protein, 120 aa, Artificial sequence
  Variable heavy chain of SC03-012
MAQVQLVQSGAEVKKPGASVKVSCKASGYTFTSYGISWVRQAPGQGLEWMGWISAYNGNTNYAQKLQGRVTMTTDTSTSTAYMELSSLRSDDTAVYYCARMFRKSSFDSWGQGTLVTVSR

SEQ ID NO: 34 - DNA, 366 bp, Artificial sequence
  CDS (1)..(366): Variable heavy chain of SC03-013
atggccgaggtgcagctggtggagtctgggggaggcttggtccagcctggagggtccctgagactctcctgtgcagcctctggattcaccttcagtgaccactacatggactgggtccgccaggctccagggaaggggctggagtgggttggccgtactagaaacaaagctaacagttacaccacagaatacgccgcgtctgtgaaaggcagattcaccatctcaagagatgattcaaagaactcactgtatctgcaaatgaacagcctgaaaaccgaggacacggccgtgtattactgtgcaaaggggttgactcctttgtactttgactactggggccaaggtaccctggtcaccgtctcgagt

SEQ ID NO: 35 - protein, 122 aa, Artificial sequence
  Variable heavy chain of SC03-013
MAEVQLVESGGGLVQPGGSLRLSCAASGFTFSDHYMDWVRQAPGKGLEWVGRTRNKANSYTTEYAASVKGRFTISRDDSKNSLYLQMNSLKTEDTAVYYCAKGLTPLYFDYWGQGTLVTVSS

SEQ ID NO: 36 - DNA, 366 bp, Artificial sequence
  CDS (1)..(366): Variable heavy chain of SC03-014
atggccgaggtgcagctggtggagtctgggggaggcttggtccagcctggagggtccctgagactctcctgtgcagcctctggattcaccttcagtgaccactacatggactgggtccgccaggctccagggaaggggctggagtgggttggccgtactagaaacaaagctaacagttacaccacagaatacgccgcgtctgtgaaaggcagattcaccatctcaagagatgattcaaagaactcactgtatctgcaaatgaacagcctgaaaaccgaggacacggccgtgtattactgtgcaagggggatttcgccgttttactttgactactggggccaaggtaccctggtcaccgtctcgagt

SEQ ID NO: 37 - protein, 122 aa, Artificial sequence
  Variable heavy chain of SC03-014
MAEVQLVESGGGLVQPGGSLRLSCAASGFTFSDHYMDWVRQAPGKGLEWVGRTRNKANSYTTEYAASVKGRFTISRDDSKNSLYLQMNSLKTEDTAVYYCARGISPFYFDYWGQGTLVTVSS

SEQ ID NO: 38 - DNA, 351 bp, Artificial sequence
  CDS (1)..(351): Variable heavy chain of SC03-015
atggccgaggtgcagctggtggagtctgggggaggtgtggtacggcctggggggtccctgagactctcctgtgcagcctctggattcacctttgatgattatggcatgagctgggtccgccaagctccagggaaggggctggagtgggtctctggtattaattggaatggtggtagcacaggttatgcagactctgtgaagggccgattcaccatctccagagacaacgccaagaactccctgtatctgcaaatgaacagtctgagagccgaggacacggccgtgtattactgtgcaagaggtttgtctcttcgtccttggggccaaggtaccctggtcaccgtctcgaga

SEQ ID NO: 39 - protein, 117 aa, Artificial sequence
  Variable heavy chain of SC03-015
MAEVQLVESGGGVVRPGGSLRLSCAASGFTFDDYGMSWVRQAPGKGLEWVSGINWNGGSTGYADSVKGRFTISRDNAKNSLYLQMNSLRAEDTAVYYCARGLSLRPWGQGTLVTVSR

SEQ ID NO: 40 - DNA, 318 bp, Artificial sequence
  CDS (1)..(318): Variable light chain of SC03-001, SC03-002, SC03-003, SC03-004, S C03-005, SC03-007, SC03-008, SC03-009, SC03-010, SC03-013, SC03-0 14, SC03-016 and SC03-018
gagctcacccagtctccatcctccctgtctgcatctgtaggagacagagtcaccatcacttgccgggcaagtcagagcattagcagctacttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctccaacgttcggccaagggaccaaggtggagatcaaacgt

SEQ ID NO: 41 - protein, 106 aa, Artificial sequence
  Variable light chain of SC03-001, SC03-002, SC03-003, SC03-004, S C03-005, SC03-007, SC03-008, SC03-009, SC03-010, SC03-013, SC03-0 14, SC03-016 and SC03-018
ELTQSPSSLSASVGDRVTITCRASQSISSYLNWYQQKPGKAPKLLIYAASSLQSGVPSRFSGSGSGTDFTLTISSLQPEDFATYYCQQSYSTPPTFGQGTKVEIKR

SEQ ID NO: 42 - DNA, 324 bp, Artificial sequence
  CDS (1)..(324): Variable light chain of SC03-006
gacatccagatgactcagtctccacactctctgtctgcatctgtaggagacagagtcaccatcacttgccgggcgagtcagggcattagcaattatttagcctggtatcagcagaaaccagggaaagttcctaagctcctgatctatgctgcatccactttgcaatcaggggtcccatctcggttcagtggcagtggatctgggacagatttcactctcaccatcagcagcctgcagcctgaagatgttggggtttattactgccagcagaggttccgcacgccggtcaccttcggccagggcaccaaactggaaatcaaacgc

SEQ ID NO: 43 - protein, 108 aa, Artificial sequence
  Variable light chain of SC03-006
DIQMTQSPHSLSASVGDRVTITCRASQGISNYLAWYQQKPGKVPKLLIYAASTLQSGVPSRFSGSGSGTDFTLTISSLQPEDVGVYYCQQRFRTPVTFGQGTKLEIKR

SEQ ID NO: 44 - DNA, 324 bp, Artificial sequence
  CDS (1)..(324): Variable light chain of SC03-012 and SC03-015
tctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggacagcagtggtaaccatgtggtattcggcggagggaccaagctgaccgtcctaggt

SEQ ID NO: 45 - protein, 108 aa, Artificial sequence
  Variable light chain of SC03-012 and SC03-015
SELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 46 - DNA, 729 bp, Artificial sequence
  CDS (1)..(729): SC03-001
tccatggctgaggtgcagctggtggagtctgggggaggcttggtaaagcctggggggtccctgagactctcctgtgcagcctctggattcaccttcagcggctactcgatgaactgggtccgccaggcgcccgggaaggggctggagtgggtctcatccattagtggtggtagcacatactacgcagactccaggaagggcagattcaccatctccagagacaattccaagaacacgctgtatcttcagatgaacaacctgagagctgaggacacggctgtgtattactgtgcaagacaccggttccggcacgtcttcgattactggggccagggcaccctggtgaccgtgctcgagggtaccggaggttccggcggaaccgggtctgggactggtacgagcgagctcacccagtctccatcctccctgtctgcatctgtaggagacagagtcaccatcacttgccgggcaagtcagagcattagcagctacttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctccaacgttcggccaagggaccaaggtggagatcaaacgtgcggccgca

SEQ ID NO: 47 - protein, 243 aa, Artificial sequence
  SC03-001
SMAEVQLVESGGGLVKPGGSLRLSCAASGFTFSGYSMNWVRQAPGKGLEWVSSISGGSTYYADSRKGRFTISRDNSKNTLYLQMNNLRAEDTAVYYCARHRFRHVFDYWGQGTLVTVLEGTGGSGGTGSGTGTSELTQSPSSLSASVGDRVTITCRASQSISSYLNWYQQKPGKAPKLLIYAASSLQSGVPSRFSGSGSGTDFTLTISSLQPEDFATYYCQQSYSTPPTFGQGTKVEIKRAAA

SEQ ID NO: 48 - DNA, 747 bp, Artificial sequence
  CDS (1)..(747): SC03-002
tccatggctgaggtgcagctggtggagtctgggggaggcctggtcaagcctggggggtccctgagactctcctgtgcagcctctggattcaccttcagcggctacagcatgagctgggtccgccaggcgcccgggaaggggctggagtgggttggccgtactagaaacaaagctaacagttacaccacagaatacgccgcgtctgtgaaaggcagattcaccatctcaagagatgattcaaagaactcactgtatctgcaaatgaacagcctgaaaaccgaggacacggccgtgtattactgtgctagatactactcccgctccctcaaggccttcgattactggggccagggcaccctggtgaccgtgctcgagggtaccggaggttccggcggaaccgggtctgggactggtacgagcgagctcacccagtctccatcctccctgtctgcatctgtaggagacagagtcaccatcacttgccgggcaagtcagagcattagcagctacttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctccaacgttcggccaagggaccaaggtggagatcaaacgtgcggccgca

SEQ ID NO: 49 - protein, 249 aa, Artificial sequence
  SC03-002
SMAEVQLVESGGGLVKPGGSLRLSCAASGFTFSGYSMSWVRQAPGKGLEWVGRTRNKANSYTTEYAASVKGRFTISRDDSKNSLYLQMNSLKTEDTAVYYCARYYSRSLKAFDYWGQGTLVTVLEGTGGSGGTGSGTGTSELTQSPSSLSASVGDRVTITCRASQSISSYLNWYQQKPGKAPKLLIYAASSLQSGVPSRFSGSGSGTDFTLTISSLQPEDFATYYCQQSYSTPPTFGQGTKVEIKRAAA

SEQ ID NO: 50 - DNA, 735 bp, Artificial sequence
  CDS (1)..(735): SC03-003
tccatggctgaggtgcagctggtggagtctgggggaggcttggtccagcctggagggtccctgagactctcctgtgcagcctctggattcaccttcagcagctacccgatgaactgggtccgccaggcgcccgggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtgtattactgtgccagacgcagctacttccgccgcttcgattactggggccagggcaccctggtgaccgtgctcgagggtaccggaggttccggcggaaccgggtctgggactggtacgagcgagctcacccagtctccatcctccctgtctgcatctgtaggagacagagtcaccatcacttgccgggcaagtcagagcattagcagctacttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctccaacgttcggccaagggaccaaggtggagatcaaacgtgcggccgca

SEQ ID NO: 51 - protein, 245 aa, Artificial sequence
  SC03-003
SMAEVQLVESGGGLVQPGGSLRLSCAASGFTFSSYPMNWVRQAPGKGLEWVSAISGSGGSTYYADSVKGRFTISRDNSKNTLYLQMNSLRAEDTAVYYCARRSYFRRFDYWGQGTLVTVLEGTGGSGGTGSGTGTSELTQSPSSLSASVGDRVTITCRASQSISSYLNWYQQKPGKAPKLLIYAASSLQSGVPSRFSGSGSGTDFTLTISSLQPEDFATYYCQQSYSTPPTFGQGTKVEIKRAAA

SEQ ID NO: 52 - DNA, 735 bp, Artificial sequence
  CDS (1)..(735): SC03-005
tccatggctgaggtgcagctggtggagtctgggggaggcttgatccagcctggggggtccctgagactctcctgtgcagcctctggattcaccttcagcggctacactatgagctgggtccgccaggcgcccgggcaggggctggagtgggtctcatccattagtggtggtagcacatactacgcagactccaggaagggcagattcaccatctccagagacaattccaagaacacgctgtatcttcaaatgaacaacctgagagctgaggacacggccgtgtattactgtgcaaaaggcggcggccgcccgtacaaccccttcgattactggggccagggcaccctggtgaccgtgctcgagggtaccggaggttccggcggaaccgggtctgggactggtacgagcgagctcacccagtctccatcctccctgtctgcatctgtaggagacagagtcaccatcacttgccgggcaagtcagagcattagcagctacttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctccaacgttcggccaagggaccaaggtggagatcaaacgtgcggccgca

SEQ ID NO: 53 - protein, 245 aa, Artificial sequence
  SC03-005
SMAEVQLVESGGGLIQPGGSLRLSCAASGFTFSGYTMSWVRQAPGQGLEWVSSISGGSTYYADSRKGRFTISRDNSKNTLYLQMNNLRAEDTAVYYCAKGGGRPYNPFDYWGQGTLVTVLEGTGGSGGTGSGTGTSELTQSPSSLSASVGDRVTITCRASQSISSYLNWYQQKPGKAPKLLIYAASSLQSGVPSRFSGSGSGTDFTLTISSLQPEDFATYYCQQSYSTPPTFGQGTKVEIKRAAA

SEQ ID NO: 54 - DNA, 753 bp, Artificial sequence
  CDS (1)..(753): SC03-006
tccatggctgaggtgcagctggtggagtctgggggaggcttggtacagcctggggggtccctgagactctcctgtgcagcctctggattcaccttcagcggctaccctatgcactgggtccgccaggcgcccgggaaggggctggagtgggtggcagttatatcatatgacggaagtaataaatactatgcagactccgtgaagggccgattcaccatctccagagacaattccaagaacacgctgtatctgcaaatgaacagcctgagagctgaggacacagctgtgtattactgtgctaaagacggcagcccccgcacccccagcttcgattactggggccagggcaccctggtgaccgtgctcgagggtaccggaggttccggcggaaccgggtctgggactggtacgagcgagctcgacatccagatgactcagtctccacactctctgtctgcatctgtaggagacagagtcaccatcacttgccgggcgagtcagggcattagcaattatttagcctggtatcagcagaaaccagggaaagttcctaagctcctgatctatgctgcatccactttgcaatcaggggtcccatctcggttcagtggcagtggatctgggacagatttcactctcaccatcagcagcctgcagcctgaagatgttggggtttattactgccagcagaggttccgcacgccggtcaccttcggccagggcaccaaactggaaatcaaacgcgcggccgca

SEQ ID NO: 55 - protein, 251 aa, Artificial sequence
  SC03-006
SMAEVQLVESGGGLVQPGGSLRLSCAASGFTFSGYPMHWVRQAPGKGLEWVAVISYDGSNKYYADSVKGRFTISRDNSKNTLYLQMNSLRAEDTAVYYCAKDGSPRTPSFDYWGQGTLVTVLEGTGGSGGTGSGTGTSELDIQMTQSPHSLSASVGDRVTITCRASQGISNYLAWYQQKPGKVPKLLIYAASTLQSGVPSRFSGSGSGTDFTLTISSLQPEDVGVYYCQQRFRTPVTFGQGTKLEIKRAAA

SEQ ID NO: 56 - DNA, 741 bp, Artificial sequence
  CDS (1)..(741): SC03-007
tccatggctgaggtgcagctggtggagtctgggggaggcttggtacagcctagggggtccctgagactctcctgtgcagcctctggattcaccttcagcgactaccggatgaactgggtccgccaggcgcccgggaaggggctggagagggtggcagttatatcatatgatggaagcaataaatactacgcagactccgtgaagggccgattcaccatctccagagacaattccaagaacacgctgtatctgcaaatgaacagcctgagagctgaggacacagccgtgtattactgtgcaagaggctactggacgtcgctcacgggcttcgattactggggccagggcaccctggtgaccgtgctcgagggtaccggaggttccggcggaaccgggtctgggactggtacgagcgagctcacccagtctccatcctccctgtctgcatctgtaggagacagagtcaccatcacttgccgggcaagtcagagcattagcagctacttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctccaacgttcggccaagggaccaaggtggagatcaaacgtgcggccgca

SEQ ID NO: 57 - protein, 247 aa, Artificial sequence
  SC03-007
SMAEVQLVESGGGLVQPRGSLRLSCAASGFTFSDYRMNWVRQAPGKGLERVAVISYDGSNKYYADSVKGRFTISRDNSKNTLYLQMNSLRAEDTAVYYCARGYWTSLTGFDYWGQGTLVTVLEGTGGSGGTGSGTGTSELTQSPSSLSASVGDRVTITCRASQSISSYLNWYQQKPGKAPKLLIYAASSLQSGVPSRFSGSGSGTDFTLTISSLQPEDFATYYCQQSYSTPPTFGQGTKVEIKRAAA

SEQ ID NO: 58 - DNA, 735 bp, Artificial sequence
  CDS (1)..(735): SC03-008
tccatggctgaggtgcagctggtggagtctgggggaggcgtggtccagcctgggaggtccctgagactctcctgtgcagcctctggattcaccttcagcagctacccgatgaactgggtccgccaggcgcccgggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacagccgtgtattactgtgcaagacgcgtccgcccccgccgcttcgattattggggccagggcaccctggtgaccgtgctcgagggtaccggaggttccggcggaaccgggtctgggactggtacgagcgagctcacccagtctccatcctccctgtctgcatctgtaggagacagagtcaccatcacttgccgggcaagtcagagcattagcagctacttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctccaacgttcggccaagggaccaaggtggagatcaaacgtgcggccgca

SEQ ID NO: 59 - protein, 245 aa, Artificial sequence
  SC03-008
SMAEVQLVESGGGVVQPGRSLRLSCAASGFTFSSYPMNWVRQAPGKGLEWVSAISGSGGSTYYADSVKGRFTISRDNSKNTLYLQMNSLRAEDTAVYYCARRVRPRRFDYWGQGTLVTVLEGTGGSGGTGSGTGTSELTQSPSSLSASVGDRVTITCRASQSISSYLNWYQQKPGKAPKLLIYAASSLQSGVPSRFSGSGSGTDFTLTISSLQPEDFATYYCQQSYSTPPTFGQGTKVEIKRAAA

SEQ ID NO: 60 - DNA, 744 bp, Artificial sequence
  CDS (1)..(744): SC03-009
tccatggctgaggtgcagctggtggagtctgggggaggcgtggtccagcctgggaggtccctgagactctcctgtgcagcctctggattcacctttagcgactaccccatgaactgggtccgccaggcgcccgggaaggggctggagtgggtctcatccattagtggtagtggtggtagcacatactacgcagactccgtgaagggccggttcaccatctccagagacaattccaagaacacgctgtatctgcaaatgaacagcctgagagccgaggacacagccgtgtattactgtgcaaaaggcctcttcatggtcaccacgtacgcgttcgattactggggccagggcaccctggtgaccgtgctcgagggtaccggaggttccggcggaaccgggtctgggactggtacgagcgagctcacccagtctccatcctccctgtctgcatctgtaggagacagagtcaccatcacttgccgggcaagtcagagcattagcagctacttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctccaacgttcggccaagggaccaaggtggagatcaaacgtgcggccgca

SEQ ID NO: 61 - protein, 248 aa, Artificial sequence
  SC03-009
SMAEVQLVESGGGVVQPGRSLRLSCAASGFTFSDYPMNWVRQAPGKGLEWVSSISGSGGSTYYADSVKGRFTISRDNSKNTLYLQMNSLRAEDTAVYYCAKGLFMVTTYAFDYWGQGTLVTVLEGTGGSGGTGSGTGTSELTQSPSSLSASVGDRVTITCRASQSISSYLNWYQQKPGKAPKLLIYAASSLQSGVPSRFSGSGSGTDFTLTISSLQPEDFATYYCQQSYSTPPTFGQGTKVEIKRAAA

SEQ ID NO: 62 - DNA, 735 bp, Artificial sequence
  CDS (1)..(735): SC03-010
tccatggctgaggtgcagctggtggagtctgggggaggcgtggtccagcctgggaggtccctgagactctcctgtgcaacctctggattcaccttcagcggctacacgatgcactgggtccgccaggcgcccgggaaggggctggagtgggtctcatccattagtggtggtagcacatactacgcagactccaggaagggcagattcaccatctccagagacaactccaagaacacgctgtatcttcaaatgaacaacctgagagctgaggacacagctgtgtattactgtgcaaaaggcggcggcctcccctacttgagcttcgattactggggccagggcaccctggtgaccgtgctcgagggtaccggaggttccggcggaaccgggtctgggactggtacgagcgagctcacccagtctccatcctccctgtctgcatctgtaggagacagagtcaccatcacttgccgggcaagtcagagcattagcagctacttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctccaacgttcggccaagggaccaaggtggagatcaaacgtgcggccgca

SEQ ID NO: 63 - protein, 245 aa, Artificial sequence
  SC03-010
SMAEVQLVESGGGVVQPGRSLRLSCATSGFTFSGYTMHWVRQAPGKGLEWVSSISGGSTYYADSRKGRFTISRDNSKNTLYLQMNNLRAEDTAVYYCAKGGGLPYLSFDYWGQGTLVTVLEGTGGSGGTGSGTGTSELTQSPSSLSASVGDRVTITCRASQSISSYLNWYQQKPGKAPKLLIYAASSLQSGVPSRFSGSGSGTDFTLTISSLQPEDFATYYCQQSYSTPPTFGQGTKVEIKRAAA

SEQ ID NO: 64 - DNA, 741 bp, Artificial sequence
  CDS (1)..(741): SC03-012
gccatggcccaggtgcagctggtgcagtctggggctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgagcagcctgagatctgacgacacggccgtgtattactgtgcaaggatgtttaggaagagttcctttgactcctggggccaaggtaccctggtcaccgtctcgagaggtggaggcggttcaggcggaggtggctctggcggtggcggatcgtctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggacagcagtggtaaccatgtggtattcggcggagggaccaagctgaccgtcctaggtgcggccgca

SEQ ID NO: 65 - protein, 247 aa, Artificial sequence
  SC03-012
AMAQVQLVQSGAEVKKPGASVKVSCKASGYTFTSYGISWVRQAPGQGLEWMGWISAYNGNTNYAQKLQGRVTMTTDTSTSTAYMELSSLRSDDTAVYYCARMFRKSSFDSWGQGTLVTVSRGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLGAAA

SEQ ID NO: 66 - DNA, 747 bp, Artificial sequence
  CDS (1)..(747): SC03-013
gccatggccgaggtgcagctggtggagtctgggggaggcttggtccagcctggagggtccctgagactctcctgtgcagcctctggattcaccttcagtgaccactacatggactgggtccgccaggctccagggaaggggctggagtgggttggccgtactagaaacaaagctaacagttacaccacagaatacgccgcgtctgtgaaaggcagattcaccatctcaagagatgattcaaagaactcactgtatctgcaaatgaacagcctgaaaaccgaggacacggccgtgtattactgtgcaaaggggttgactcctttgtactttgactactggggccaaggtaccctggtcaccgtctcgagtggtggaggcggttcaggcggaggtggctctggcggtggcggatcggaaattgagctcacccagtctccatcctccctgtctgcatctgtaggagacagagtcaccatcacttgccgggcaagtcagagcattagcagctacttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctccaacgttcggccaagggaccaaggtggagatcaaacgtgcggccgca

SEQ ID NO: 67 - protein, 249 aa, Artificial sequence
  SC03-013
AMAEVQLVESGGGLVQPGGSLRLSCAASGFTFSDHYMDWVRQAPGKGLEWVGRTRNKANSYTTEYAASVKGRFTISRDDSKNSLYLQMNSLKTEDTAVYYCAKGLTPLYFDYWGQGTLVTVSSGGGGSGGGGSGGGGSEIELTQSPSSLSASVGDRVTITCRASQSISSYLNWYQQKPGKAPKLLIYAASSLQSGVPSRFSGSGSGTDFTLTISSLQPEDFATYYCQQSYSTPPTFGQGTKVEIKRAAA

SEQ ID NO: 68 - DNA, 747 bp, Artificial sequence
  CDS (1)..(747): SC03-014
gccatggccgaggtgcagctggtggagtctgggggaggcttggtccagcctggagggtccctgagactctcctgtgcagcctctggattcaccttcagtgaccactacatggactgggtccgccaggctccagggaaggggctggagtgggttggccgtactagaaacaaagctaacagttacaccacagaatacgccgcgtctgtgaaaggcagattcaccatctcaagagatgattcaaagaactcactgtatctgcaaatgaacagcctgaaaaccgaggacacggccgtgtattactgtgcaagggggatttcgccgttttactttgactactggggccaaggtaccctggtcaccgtctcgagtggtggaggcggttcaggcggaggtggctctggcggtggcggatcggaaattgagctcacccagtctccatcctccctgtctgcatctgtaggagacagagtcaccatcacttgccgggcaagtcagagcattagcagctacttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctccaacgttcggccaagggaccaaggtggagatcaaacgtgcggccgca

SEQ ID NO: 69 - protein, 249 aa, Artificial sequence
  SC03-014
AMAEVQLVESGGGLVQPGGSLRLSCAASGFTFSDHYMDWVRQAPGKGLEWVGRTRNKANSYTTEYAASVKGRFTISRDDSKNSLYLQMNSLKTEDTAVYYCARGISPFYFDYWGQGTLVTVSSGGGGSGGGGSGGGGSEIELTQSPSSLSASVGDRVTITCRASQSISSYLNWYQQKPGKAPKLLIYAASSLQSGVPSRFSGSGSGTDFTLTISSLQPEDFATYYCQQSYSTPPTFGQGTKVEIKRAAA

SEQ ID NO: 70 - DNA, 732 bp, Artificial sequence
  CDS (1)..(732): SC03-015
gccatggccgaggtgcagctggtggagtctgggggaggtgtggtacggcctggggggtccctgagactctcctgtgcagcctctggattcacctttgatgattatggcatgagctgggtccgccaagctccagggaaggggctggagtgggtctctggtattaattggaatggtggtagcacaggttatgcagactctgtgaagggccgattcaccatctccagagacaacgccaagaactccctgtatctgcaaatgaacagtctgagagccgaggacacggccgtgtattactgtgcaagaggtttgtctcttcgtccttggggccaaggtaccctggtcaccgtctcgagaggtggaggcggttcaggcggaggtggctctggcggtggcggatcgtctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggacagcagtggtaaccatgtggtattcggcggagggaccaagctgaccgtcctaggtgcggccgca

SEQ ID NO: 71 - protein, 244 aa, Artificial sequence
  SC03-015
AMAEVQLVESGGGVVRPGGSLRLSCAASGFTFDDYGMSWVRQAPGKGLEWVSGINWNGGSTGYADSVKGRFTISRDNAKNSLYLQMNSLRAEDTAVYYCARGLSLRPWGQGTLVTVSRGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLGAAA

SEQ ID NO: 72 - DNA, 55 bp, Artificial sequence
  5' cloning site of pPicZalphaB
tctctcgagaaaagagaggctgaagctgcaggaattcacgtggcccagccggccg

SEQ ID NO: 73 - DNA, 55 bp, Artificial sequence
  5' cloning site of pPicZFVH
tctctcgagaaaagagccatggaagctgcaggaattcacgtggcccagccggccg

SEQ ID NO: 74 - DNA, 92 bp, Artificial sequence
  Synthetic hinge fragment
gcggccgcgccaaagccaagtaccccaccaggttcttcatgtccaccatgtccaggctctggcggtgcgccaatcgatagcggctttctaga

SEQ ID NO: 75 - protein, 11 aa, Artificial sequence
  HCDR3 of SC03-004
DGSRFPARFDY

SEQ ID NO: 76 - protein, 11 aa, Artificial sequence
  HCDR3 of SC03-016
YGSAYRPPFDY

SEQ ID NO: 77 - protein, 9 aa, Artificial sequence
  HCDR3 of SC03-017
SRSAGFFDY

SEQ ID NO: 78 - protein, 9 aa, Artificial sequence
  HCDR3 of SC03-018
FNPFTSFDY

SEQ ID NO: 79 - DNA, 372 bp, Artificial sequence
  CDS (1)..(372): Variable heavy chain of SC03-004
atggctgaggtgcagctggtggagtctgggggaggcttggtacagcctggggggtccctgagactctcctgtgcagcctctggattcacctttagcgactacttgatgaactgggtccgccaggcgcccgggaaggggctggagtgggttggccgtattagaagcaaagctaacagttacgcgacagcatatgctgcgtcggtgaaaggcaggttcaccatctccagagatgattcaaagaacacggcgtatctgcaaatgaacagcctgaaaaccgaggacacggccgtgtattactgtgctaaagacggcagccggttccccgcccgcttcgattactggggccagggcaccctggtgaccgtgctcgag

SEQ ID NO: 80 - protein, 124 aa, Artificial sequence
  Variable heavy chain of SC03-004
MAEVQLVESGGGLVQPGGSLRLSCAASGFTFSDYLMNWVRQAPGKGLEWVGRIRSKANSYATAYAASVKGRFTISRDDSKNTAYLQMNSLKTEDTAVYYCAKDGSRFPARFDYWGQGTLVTVLE

SEQ ID NO: 81 - DNA, 372 bp, Artificial sequence
  Variable heavy chain of SC03-016
atggctgaggtgtagctggtggagtctgggggaggcttggtccagcctggagggtccctgagactctcccgtgcagcctctggattcacctttagcaactaccccatgcgctgggtccgccaggcgcccgggaaggggctggagtgggtaggtttcattagaaacaaagctaatggtgggacaacagaatagaccacgtctgtgagaggcagattcacaatctcaagagatgattccaaaagcatcacctatctgcaaatgaacagcctgagagccgaggacacagccgtgtattactgtgctaaatacggcagcgcctaccgcccgcccttcgattactggggccagggcaccctggtgaccgtgctcgag

SEQ ID NO: 82 - protein, 125 aa, Artificial sequence
  Variable heavy chain of SC03-016
AMAEVQLVESGGGLVQPGGSLRLSRAASGFTFSNYPMRWVRQAPGKGLEWVGFIRNKANGGTTEQTTSVRGRFTISRDDSKSITYLQMNSLRAEDTAVYYCAKYGSAYRPPFDYWGQGTLVTVLE

SEQ ID NO: 83 - DNA, 363 bp, Artificial sequence
  CDS (1)..(363): Variable heavy chain of SC03-017
atggcccaggtgcagctgcaggagtcgggcgcaggactgttgaagccttcggagaccctgtccctcacctgcactgtctctggtggctccgtcagcagtggtagttactactggagctggatccggcagcccccagggaagggactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattactgtgcaaagtctcgttctgctggtttctttgactactggggccaaggtaccctggtcaccgtctcgagt

SEQ ID NO: 84 - protein, 121 aa, Artificial sequence
  Variable heavy chain of SC03-017
MAQVQLQESGAGLLKPSETLSLTCTVSGGSVSSGSYYWSWIRQPPGKGLEWIGYIYYSGSTNYNPSLKSRVTISVDTSKNQFSLKLSSVTAADTAVYYCAKSRSAGFFDYWGQGTLVTVSS

SEQ ID NO: 85 - DNA, 360 bp, Artificial sequence
  CDS (1)..(360): Variable heavy chain of SC03-018
atggccgaggtgcagctggtggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtgtattactgtgcaaagtttaatccgtttacttcctttgactactggggccaaggtaccctggtcaccgtctcgagt

SEQ ID NO: 86 - protein, 120 aa, Artificial sequence
  Variable heavy chain of SC03-018
MAEVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKFNPFTSFDYWGQGTLVTVSS

SEQ ID NO: 87 - DNA, 324 bp, Artificial sequence
  CDS (1)..(324): Variable light chain of SC03-017
gaaattgagctcacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctccggctttcggcggagggaccaaggtggagatcaaacgt

SEQ ID NO: 88 - protein, 108 aa, Artificial sequence
  Variable light chain of SC03-017
EIELTQSPATLSLSPGERATLSCRASQSVSSYLAWYQQKPGQAPRLLIYDASNRATGIPARFSGSGSGTDFTLTISSLEPEDFAVYYCQQRSNWPPAFGGGTKVEIKR

SEQ ID NO: 89 - DNA, 747 bp, Artificial sequence
  CDS (1)..(747): SC03-004
tccatggctgaggtgcagctggtggagtctgggggaggcttggtacagcctggggggtccctgagactctcctgtgcagcctctggattcacctttagcgactacttgatgaactgggtccgccaggcgcccgggaaggggctggagtgggttggccgtattagaagcaaagctaacagttacgcgacagcatatgctgcgtcggtgaaaggcaggttcaccatctccagagatgattcaaagaacacggcgtatctgcaaatgaacagcctgaaaaccgaggacacggccgtgtattactgtgctaaagacggcagccggttccccgcccgcttcgattactggggccagggcaccctggtgaccgtgctcgagggtaccggaggttccggcggaaccgggtctgggactggtacgagcgagctcacccagtctccatcctccctgtctgcatctgtaggagacagagtcaccatcacttgccgggcaagtcagagcattagcagctacttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctccaacgttcggccaagggaccaaggtggagatcaaacgtgcggccgca

SEQ ID NO: 90 - protein, 249 aa, Artificial sequence
  SC03-004
SMAEVQLVESGGGLVQPGGSLRLSCAASGFTFSDYLMNWVRQAPGKGLEWVGRIRSKANSYATAYAASVKGRFTISRDDSKNTAYLQMNSLKTEDTAVYYCAKDGSRFPARFDYWGQGTLVTVLEGTGGSGGTGSGTGTSELTQSPSSLSASVGDRVTITCRASQSISSYLNWYQQKPGKAPKLLIYAASSLQSGVPSRFSGSGSGTDFTLTISSLQPEDFATYYCQQSYSTPPTFGQGTKVEIKRAAA

SEQ ID NO: 91 - DNA, 747 bp, Artificial sequence
  SC03-016
gccatggctgaggtgtagctggtggagtctgggggaggcttggtccagcctggagggtccctgagactctcccgtgcagcctctggattcacctttagcaactaccccatgcgctgggtccgccaggcgcccgggaaggggctggagtgggtaggtttcattagaaacaaagctaatggtgggacaacagaatagaccacgtctgtgagaggcagattcacaatctcaagagatgattccaaaagcatcacctatctgcaaatgaacagcctgagagccgaggacacagccgtgtattactgtgctaaatacggcagcgcctaccgcccgcccttcgattactggggccagggcaccctggtgaccgtgctcgagggtaccggaggttccggcggaaccgggtctgggactggtacgagcgagctcacccagtctccatcctccctgtctgcatctgtaggagacagagtcaccatcacttgccgggcaagtcagagcattagcagctacttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctccaacgttcggccaagggaccaaggtggagatcaaacgtgcggccgca

SEQ ID NO: 92 - protein, 249 aa, Artificial sequence
  SC03-016
AMAEVQLVESGGGLVQPGGSLRLSRAASGFTFSNYPMRWVRQAPGKGLEWVGFIRNKANGGTTEQTTSVRGRFTISRDDSKSITYLQMNSLRAEDTAVYYCAKYGSAYRPPFDYWGQGTLVTVLEGTGGSGGTGSGTGTSELTQSPSSLSASVGDRVTITCRASQSISSYLNWYQQKPGKAPKLLIYAASSLQSGVPSRFSGSGSGTDFTLTISSLQPEDFATYYCQQSYSTPPTFGQGTKVEIKRAAA

SEQ ID NO: 93 - DNA, 744 bp, Artificial sequence
  CDS (1)..(744): SC03-017
gccatggcccaggtgcagctgcaggagtcgggcgcaggactgttgaagccttcggagaccctgtccctcacctgcactgtctctggtggctccgtcagcagtggtagttactactggagctggatccggcagcccccagggaagggactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattactgtgcaaagtctcgttctgctggtttctttgactactggggccaaggtaccctggtcaccgtctcgagtggtggaggcggttcaggcggaggtggctctggcggtggcggatcggaaattgagctcacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctccggctttcggcggagggaccaaggtggagatcaaacgtgcggccgca

SEQ ID NO: 94 - protein, 248 aa, Artificial sequence
  SC03-017
AMAQVQLQESGAGLLKPSETLSLTCTVSGGSVSSGSYYWSWIRQPPGKGLEWIGYIYYSGSTNYNPSLKSRVTISVDTSKNQFSLKLSSVTAADTAVYYCAKSRSAGFFDYWGQGTLVTVSSGGGGSGGGGSGGGGSEIELTQSPATLSLSPGERATLSCRASQSVSSYLAWYQQKPGQAPRLLIYDASNRATGIPARFSGSGSGTDFTLTISSLEPEDFAVYYCQQRSNWPPAFGGGTKVEIKRAAA

SEQ ID NO: 95 - DNA, 741 bp, Artificial sequence
  CDS (1)..(741): SC03-018
gccatggccgaggtgcagctggtggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtgtattactgtgcaaagtttaatccgtttacttcctttgactactggggccaaggtaccctggtcaccgtctcgagtggtggaggcggttcaggcggaggtggctctggcggtggcggatcggaaattgagctcacccagtctccatcctccctgtctgcatctgtaggagacagagtcaccatcacttgccgggcaagtcagagcattagcagctacttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctccaacgttcggccaagggaccaaggtggagatcaaacgtgcggccgca

SEQ ID NO: 96 - protein, 247 aa, Artificial sequence
  SC03-018
AMAEVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKFNPFTSFDYWGQGTLVTVSSGGGGSGGGGSGGGGSEIELTQSPSSLSASVGDRVTITCRASQSISSYLNWYQQKPGKAPKLLIYAASSLQSGVPSRFSGSGSGTDFTLTISSLQPEDFATYYCQQSYSTPPTFGQGTKVEIKRAAA

SEQ ID NO: 97 - protein, 15 aa, Artificial sequence
  Peptide
NGPQSNQRSAPRITF

SEQ ID NO: 98 - protein, 15 aa, Artificial sequence
  Peptide
GPQSNQRSAPRITFG

SEQ ID NO: 99 - protein, 15 aa, Artificial sequence
  Peptide
PQSNQRSAPRITFGG

SEQ ID NO: 100 - protein, 15 aa, Artificial sequence
  Peptide
QSNQRSAPRITFGGP

SEQ ID NO: 101 - protein, 15 aa, Artificial sequence
  Peptide
SNQRSAPRITFGGPT

SEQ ID NO: 102 - protein, 15 aa, Artificial sequence
  Peptide
NQRSAPRITFGGPTD

SEQ ID NO: 103 - protein, 15 aa, Artificial sequence
  Peptide
QRSAPRITFGGPTDS

SEQ ID NO: 104 - protein, 15 aa, Artificial sequence
  Peptide
RSAPRITFGGPTDST

SEQ ID NO: 105 - protein, 15 aa, Artificial sequence
  Peptide
SAPRITFGGPTDSTD

SEQ ID NO: 106 - protein, 15 aa, Artificial sequence
  Peptide
APRITFGGPTDSTDN

SEQ ID NO: 107 - protein, 15 aa, Artificial sequence
  Peptide
PRITFGGPTDSTDNN

SEQ ID NO: 108 - protein, 15 aa, Artificial sequence
  Peptide
RITFGGPTDSTDNNQ

SEQ ID NO: 109 - protein, 15 aa, Artificial sequence
  Peptide
ITFGGPTDSTDNNQN

SEQ ID NO: 110 - DNA, 6778 bp, Artificial sequence
  Vector pSyn-C03-HCgamma1
gacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgctaggtggtcaatattggccattagccatattattcattggttatatagcataaatcaatattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaagctggcctggatggcctgactctcttaggtagccttgcagaagttggtcgtgaggcactgggcaggtaagtatcaaggttacaagacaggtttaaggagatcaatagaaactgggcttgtcgagacagagaagactcttgcgtttctgataggcacctattggtcttactgacatccactttgcctttctctccacaggtgtccactcccagttcaattacagctcgccaccatggcctgccccggcttcctgtgggccctggtgatcagcacctgcctggaattcagcatgagcagcgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaagtgataatctagagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggatcgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtc

SEQ ID NO: 111 - DNA, 6267 bp, Artificial sequence
  Vector pSyn-C05-Ckappa
gacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgttaattaacatgaagaatctgcttagggttaggcgttttgcgctgcttcgctaggtggtcaatattggccattagccatattattcattggttatatagcataaatcaatattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaatcgatgactctcttaggtagccttgcagaagttggtcgtgaggcactgggcaggtaagtatcaaggttacaagacaggtttaaggagatcaatagaaactgggcttgtcgagacagagaagactcttgcgtttctgataggcacctattggtcttactgacatccactttgcctttctctccacaggtgtccactcccagttcaattacagctcgccaccatggcctgccccggcttcctgtgggccctggtgatcagcacctgcctcgagttcagcggccctaagcggaccgtggccgctcccagcgtgttcatcttccccccctccgacgagcagctgaagagcggcaccgccagcgtggtgtgcctgctgaacaacttctacccccgggaggccaaggtgcagtggaaggtggacaacgccctgcagagcggcaacagccaggagagcgtgaccgagcaggacagcaaggactccacctacagcctgagcagcaccctcaccctgagcaaggccgactacgagaagcacaaggtgtacgcctgcgaggtgacccaccagggcctgagcagccccgtgaccaagagcttcaaccggggcgagtgttaatagacttaagtttaaaccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggccatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcagcacgtgatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccacaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagcacgtgctacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtc

SEQ ID NO: 112 - DNA, 54 bp, Artificial sequence
  Oligonucleotide 5K-I
acctgtctcgagttttccatggctgacatccagatgacccagtctccatcctcc

SEQ ID NO: 113 - DNA, 42 bp, Artificial sequence
  Oligonucleotide sy3K-C
gggaccaaggtggagatcaaacggaccgtggccgcccccagc

SEQ ID NO: 114 - DNA, 46 bp, Artificial sequence
  Oligonucleotide 5H-B
acctgtcttgaattctccatggccgaggtgcagctggtggagtctg

SEQ ID NO: 115 - DNA, 47 bp, Artificial sequence
  Oligonucleotide sy3H-A
gcccttggtgctagcgctggagacggtcaccagggtgccctggcccc

SEQ ID NO: 116 - DNA, 1338 bp, Artificial sequence
  CDS (1)..(1338): IgG heavy chain sequence 03-001
gaggtgcagctggtggagtctgggggaggcttggtaaagcctggggggtccctgagactctcctgtgcagcctctggattcaccttcagcggctactcgatgaactgggtccgccaggcgcccgggaaggggctggagtgggtctcatccattagtggtggtagcacatactacgcagactccaggaagggcagattcaccatctccagagacaattccaagaacacgctgtatcttcagatgaacaacctgagagctgaggacacggctgtgtattactgtgcaagacaccggttccggcacgtcttcgattactggggccagggcaccctggtgaccgtctccagcgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 117 - protein, 446 aa, Artificial sequence
  IgG heavy chain sequence 03-001
EVQLVESGGGLVKPGGSLRLSCAASGFTFSGYSMNWVRQAPGKGLEWVSSISGGSTYYADSRKGRFTISRDNSKNTLYLQMNNLRAEDTAVYYCARHRFRHVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 118 - DNA, 1356 bp, Artificial sequence
  CDS (1)..(1356): IgG heavy chain sequence of 03-002
gaggtgcagctggtggagtctgggggaggcctggtcaagcctggggggtccctgagactctcctgtgcagcctctggattcaccttcagcggctacagcatgagctgggtccgccaggcgcccgggaaggggctggagtgggttggccgtactagaaacaaagctaacagttacaccacagaatacgccgcgtctgtgaaaggcagattcaccatctcaagagatgattcaaagaactcactgtatctgcaaatgaacagcctgaaaaccgaggacacggccgtgtattactgtgctagatactactcccgctccctcaaggccttcgattactggggccagggcaccctggtgaccgtctccagcgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 119 - protein, 452 aa, Artificial sequence
  IgG heavy chain sequence of 03-002
EVQLVESGGGLVKPGGSLRLSCAASGFTFSGYSMSWVRQAPGKGLEWVGRTRNKANSYTTEYAASVKGRFTISRDDSKNSLYLQMNSLKTEDTAVYYCARYYSRSLKAFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 120 - DNA, 1353 bp, Artificial sequence
  CDS (1)..(1353): IgG heavy chain sequence 03-009
gaggtgcagctggtggagtctgggggaggcgtggtccagcctgggaggtccctgagactctcctgtgcagcctctggattcacctttagcgactaccccatgaactgggtccgccaggcgcccgggaaggggctggagtgggtctcatccattagtggtagtggtggtagcacatactacgcagactccgtgaagggccggttcaccatctccagagacaattccaagaacacgctgtatctgcaaatgaacagcctgagagccgaggacacagccgtgtattactgtgcaaaaggcctcttcatggtcaccacgtacgcgttcgattactggggccagggcaccctggtgaccgtctccagcgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 121 - protein, 451 aa, Artificial sequence
  IgG heavy chain sequence 03-009
EVQLVESGGGVVQPGRSLRLSCAASGFTFSDYPMNWVRQAPGKGLEWVSSISGSGGSTYYADSVKGRFTISRDNSKNTLYLQMNSLRAEDTAVYYCAKGLFMVTTYAFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 122 - DNA, 1350 bp, Artificial sequence
  CDS (1)..(1350): IgG heavy chain of 03-013
gaggtgcagctggtggagtctgggggaggcttggtccagcctggagggtccctgagactctcctgtgcagcctctggattcaccttcagtgaccactacatggactgggtccgccaggctccagggaaggggctggagtgggttggccgtactagaaacaaagctaacagttacaccacagaatacgccgcgtctgtgaaaggcagattcaccatctcaagagatgattcaaagaactcactgtatctgcaaatgaacagcctgaaaaccgaggacacggccgtgtattactgtgcaaaggggttgactcctttgtactttgactactggggccagggcaccctggtgaccgtctccagcgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 123 - protein, 450 aa, Artificial sequence
  IgG heavy chain of 03-013
EVQLVESGGGLVQPGGSLRLSCAASGFTFSDHYMDWVRQAPGKGLEWVGRTRNKANSYTTEYAASVKGRFTISRDDSKNSLYLQMNSLKTEDTAVYYCAKGLTPLYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 124 - DNA, 1350 bp, Artificial sequence
  CDS (1)..(1350): IgG heavy chain of 03-014
gaggtgcagctggtggagtctgggggaggcttggtccagcctggagggtccctgagactctcctgtgcagcctctggattcaccttcagtgaccactacatggactgggtccgccaggctccagggaaggggctggagtgggttggccgtactagaaacaaagctaacagttacaccacagaatacgccgcgtctgtgaaaggcagattcaccatctcaagagatgattcaaagaactcactgtatctgcaaatgaacagcctgaaaaccgaggacacggccgtgtattactgtgcaagggggatttcgccgttttactttgactactggggccagggcaccctggtgaccgtctccagcgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 125 - protein, 450 aa, Artificial sequence
  IgG heavy chain of 03-014
EVQLVESGGGLVQPGGSLRLSCAASGFTFSDHYMDWVRQAPGKGLEWVGRTRNKANSYTTEYAASVKGRFTISRDDSKNSLYLQMNSLKTEDTAVYYCARGISPFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 126 - DNA, 1344 bp, Artificial sequence
  CDS (1)..(1344): IgG heavy chain of 03-018
gaggtgcagctggtggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtgtattactgtgcaaagtttaatccgtttacttcctttgactactggggccagggcaccctggtgaccgtctccagcgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 127 - protein, 448 aa, Artificial sequence
  IgG heavy chain of 03-018
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKFNPFTSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 128 - DNA, 642 bp, Artificial sequence
  CDS (1)..(642): IgG light chain of 03-001, 03-002, 03-009, 03-013, 03-014 and 03- 018
gacattcagatgacccagtctccatcctccctgtctgcatctgtaggagacagagtcaccatcacttgccgggcaagtcagagcattagcagctacttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctccaacgttcggccaagggaccaaggtggagatcaaacggaccgtggccgctcccagcgtgttcatcttccccccctccgacgagcagctgaagagcggcaccgccagcgtggtgtgcctgctgaacaacttctacccccgggaggccaaggtgcagtggaaggtggacaacgccctgcagagcggcaacagccaggagagcgtgaccgagcaggacagcaaggactccacctacagcctgagcagcaccctcaccctgagcaaggccgactacgagaagcacaaggtgtacgcctgcgaggtgacccaccagggcctgagcagccccgtgaccaagagcttcaaccggggcgagtgt

SEQ ID NO: 129 - protein, 214 aa, Artificial sequence
  IgG light chain of 03-001, 03-002, 03-009, 03-013, 03-014 and 03- 018
DIQMTQSPSSLSASVGDRVTITCRASQSISSYLNWYQQKPGKAPKLLIYAASSLQSGVPSRFSGSGSGTDFTLTISSLQPEDFATYYCQQSYSTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 130 - DNA, 4914 bp, Artificial sequence
  Vector pDV-C05
aagcttgcatgcaaattctatttcaaggagacagtcataatgaaatacctattgcctacggcagccgctggattgttattactcgcggcccagccggccatggccgaggtgtttgactaatggggcgcgcctcagggaaccctggtcaccgtctcgagcggtacgggcggttcaggcggaaccggcagcggcactggcgggtcgacggaaattgtgctcacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctccggctttcggcggagggaccaaggtggagatcaaacgtgcggccgcatataccgatattgaaatgaaccgcctgggcaaaggggccgcatagactgttgaaagttgtttagcaaaacctcatacagaaaattcatttactaacgtctggaaagacgacaaaactttagatcgttacgctaactatgagggctgtctgtggaatgctacaggcgttgtggtttgtactggtgacgaaactcagtgttacggtacatgggttcctattgggcttgctatccctgaaaatgagggtggtggctctgagggtggcggttctgagggtggcggttctgagggtggcggtactaaacctcctgagtacggtgatacacctattccgggctatacttatatcaaccctctcgacggcacttatccgcctggtactgagcaaaaccccgctaatcctaatccttctcttgaggagtctcagcctcttaatactttcatgtttcagaataataggttccgaaataggcagggtgcattaactgtttatacgggcactgttactcaaggcactgaccccgttaaaacttattaccagtacactcctgtatcatcaaaagccatgtatgacgcttactggaacggtaaattcagagactgcgctttccattctggctttaatgaggatccattcgtttgtgaatatcaaggccaatcgtctgacctgcctcaacctcctgtcaatgctggcggcggctctggtggtggttctggtggcggctctgagggtggcggctctgagggtggcggttctgagggtggcggctctgagggtggcggttccggtggcggctccggttccggtgattttgattatgaaaaaatggcaaacgctaataagggggctatgaccgaaaatgccgatgaaaacgcgctacagtctgacgctaaaggcaaacttgattctgtcgctactgattacggtgctgctatcgatggtttcattggtgacgtttccggccttgctaatggtaatggtgctactggtgattttgctggctctaattcccaaatggctcaagtcggtgacggtgataattcacctttaatgaataatttccgtcaatatttaccttctttgcctcagtcggttgaatgtcgcccttatgtctttggcgctggtaaaccatatgaattttctattgattgtgacaaaataaacttattccgtggtgtctttgcgtttcttttatatgttgccacctttatgtatgtattttcgacgtttgctaacatactgcgtaataaggagtcttaataagaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgcc

SEQ ID NO: 131 - DNA, 24 bp, Artificial sequence
  primer HuCIgG
gtccaccttggtgttgctgggctt

SEQ ID NO: 132 - DNA, 23 bp, Artificial sequence
  primer HuVH1B/7A
cagrtgcagctggtgcartctgg

SEQ ID NO: 133 - DNA, 23 bp, Artificial sequence
  primer HuVH1C
saggtccagctggtrcagtctgg

SEQ ID NO: 134 - DNA, 23 bp, Artificial sequence
  primer HuVH2B
saggtgcagctggtggagtctgg

SEQ ID NO: 135 - DNA, 23 bp, Artificial sequence
  primer HuVH3B
saggtgcagctggtggagtctgg

SEQ ID NO: 136 - DNA, 23 bp, Artificial sequence
  primer HuVH3C
gaggtgcagctggtggagwcygg

SEQ ID NO: 137 - DNA, 23 bp, Artificial sequence
  primer HuVH4B
caggtgcagctacagcagtgggg

SEQ ID NO: 138 - DNA, 23 bp, Artificial sequence
  primer HuVH4C
cagstgcagctgcaggagtcsgg

SEQ ID NO: 139 - DNA, 23 bp, Artificial sequence
  primer HuVH5B
gargtgcagctggtgcagtctgg

SEQ ID NO: 140 - DNA, 23 bp, Artificial sequence
  primer HuVH6A
caggtacagctgcagcagtcagg

SEQ ID NO: 141 - DNA, 24 bp, Artificial sequence
  primer HuJH1/2
tgaggagacggtgaccagggtgcc

SEQ ID NO: 142 - DNA, 24 bp, Artificial sequence
  primer HuJH3
tgaagagacggtgaccattgtccc

SEQ ID NO: 143 - DNA, 24 bp, Artificial sequence
  primer HuJH4/5
tgaggagacggtgaccagggttcc

SEQ ID NO: 144 - DNA, 24 bp, Artificial sequence
  primer HuJH6
tgaggagacggtgaccgtggtccc

SEQ ID NO: 145 - DNA, 56 bp, Artificial sequence
  primer HuVH1B/7A-NcoI
gtcctcgcaactgcggcccagccggccatggcccagrtgcagctggtgcartctgg

SEQ ID NO: 146 - DNA, 56 bp, Artificial sequence
  primer HuVH1C-NcoI
gtcctcgcaactgcggcccagccggccatggccsaggtccagctggtrcagtctgg

SEQ ID NO: 147 - DNA, 56 bp, Artificial sequence
  primer HuVH2B-NcoI
gtcctcgcaactgcggcccagccggccatggcccagrtcaccttgaaggagtctgg

SEQ ID NO: 148 - DNA, 56 bp, Artificial sequence
  primer HuVH3B-NcoI
gtcctcgcaactgcggcccagccggccatggccsaggtgcagctggtggagtctgg

SEQ ID NO: 149 - DNA, 56 bp, Artificial sequence
  primer HuVH3C-NcoI
gtcctcgcaactgcggcccagccggccatggccgaggtgcagctggtggagwcygg

SEQ ID NO: 150 - DNA, 56 bp, Artificial sequence
  primer HuVH4B-NcoI
gtcctcgcaactgcggcccagccggccatggcccaggtgcagctacagcagtgggg

SEQ ID NO: 151 - DNA, 56 bp, Artificial sequence
  primer HuVH4C-NcoI
gtcctcgcaactgcggcccagccggccatggcccagstgcagctgcaggagtcsgg

SEQ ID NO: 152 - DNA, 56 bp, Artificial sequence
  primer HuVH5B-NcoI
gtcctcgcaactgcggcccagccggccatggccgargtgcagctggtgcagtctgg

SEQ ID NO: 153 - DNA, 56 bp, Artificial sequence
  primer HuVH6A-NcoI
gtcctcgcaactgcggcccagccggccatggcccaggtacagctgcagcagtcagg

SEQ ID NO: 154 - DNA, 36 bp, Artificial sequence
  primer HuJH1/2-XhoI
gagtcattctcgactcgagacggtgaccagggtgcc

SEQ ID NO: 155 - DNA, 36 bp, Artificial sequence
  primer HuJH3-XhoI
gagtcattctcgactcgagacggtgaccattgtccc

SEQ ID NO: 156 - DNA, 36 bp, Artificial sequence
  primer HuJH4/5-XhoI
gagtcattctcgactcgagacggtgaccagggttcc

SEQ ID NO: 157 - DNA, 36 bp, Artificial sequence
  primer HuJH6- XhoI
gagtcattctcgactcgagacggtgaccgtggtccc

SEQ ID NO: 158 - DNA, 24 bp, Artificial sequence
  primer HuCk
acactctcccctgttgaagctctt

SEQ ID NO: 159 - DNA, 23 bp, Artificial sequence
  primer HuClambda2
tgaacattctgtaggggccactg

SEQ ID NO: 160 - DNA, 23 bp, Artificial sequence
  primer HuClambda7
agagcattctgcaggggccactg

SEQ ID NO: 161 - DNA, 23 bp, Artificial sequence
  primer HuVlambda1A
cagtctgtgctgactcagccacc

SEQ ID NO: 162 - DNA, 23 bp, Artificial sequence
  primer HuVlambda1B
cagtctgtgytgacgcagccgcc

SEQ ID NO: 163 - DNA, 23 bp, Artificial sequence
  primer HuVlambda1C
cagtctgtcgtgacgcagccgcc

SEQ ID NO: 164 - DNA, 21 bp, Artificial sequence
  primer HuVlambda2
cartctgccctgactcagcct

SEQ ID NO: 165 - DNA, 23 bp, Artificial sequence
  primer HuVlambda3A
tcctatgwgctgactcagccacc

SEQ ID NO: 166 - DNA, 23 bp, Artificial sequence
  primer HuVlambda3B
tcttctgagctgactcaggaccc

SEQ ID NO: 167 - DNA, 23 bp, Artificial sequence
  primer HuVlambda4
cacgttatactgactcaaccgcc

SEQ ID NO: 168 - DNA, 23 bp, Artificial sequence
  primer HuVlambda5
caggctgtgctgactcagccgtc

SEQ ID NO: 169 - DNA, 23 bp, Artificial sequence
  primer HuVlambda6
aattttatgctgactcagcccca

SEQ ID NO: 170 - DNA, 23 bp, Artificial sequence
  primer HuVlambda7/8
cagrctgtggtgacycaggagcc

SEQ ID NO: 171 - DNA, 23 bp, Artificial sequence
  primer HuVlambda9
cwgcctgtgctgactcagccmcc

SEQ ID NO: 172 - DNA, 23 bp, Artificial sequence
  primer HuVkappa1B
gacatccagwtgacccagtctcc

SEQ ID NO: 173 - DNA, 23 bp, Artificial sequence
  primer HuVkappa2
gatgttgtgatgactcagtctcc

SEQ ID NO: 174 - DNA, 23 bp, Artificial sequence
  primer HuVkappa3
gaaattgtgwtgacrcagtctcc

SEQ ID NO: 175 - DNA, 23 bp, Artificial sequence
  primer HuVkappa4
gatattgtgatgacccacactcc

SEQ ID NO: 176 - DNA, 23 bp, Artificial sequence
  primer HuVkappa5
gaaacgacactcacgcagtctcc

SEQ ID NO: 177 - DNA, 23 bp, Artificial sequence
  primer HuVkappa6
gaaattgtgctgactcagtctcc

SEQ ID NO: 178 - DNA, 24 bp, Artificial sequence
  primer HuJlambda1
acctaggacggtgaccttggtccc

SEQ ID NO: 179 - DNA, 24 bp, Artificial sequence
  primer HuJlambda2/3
acctaggacggtcagcttggtccc

SEQ ID NO: 180 - DNA, 24 bp, Artificial sequence
  primer HuJlambda4/5
acytaaaacggtgagctgggtccc

SEQ ID NO: 181 - DNA, 24 bp, Artificial sequence
  primer HuJkappa1
acgtttgatttccaccttggtccc

SEQ ID NO: 182 - DNA, 24 bp, Artificial sequence
  primer HuJkappa2
acgtttgatctccagcttggtccc

SEQ ID NO: 183 - DNA, 24 bp, Artificial sequence
  primer HuJkappa3
acgtttgatatccactttggtccc

SEQ ID NO: 184 - DNA, 24 bp, Artificial sequence
  primer HuJkappa4
acgtttgatctccaccttggtccc

SEQ ID NO: 185 - DNA, 24 bp, Artificial sequence
  primer HuJkappa5
acgtttaatctccagtcgtgtccc

SEQ ID NO: 186 - DNA, 41 bp, Artificial sequence
  primer HuVkappa1B-SalI
tgagcacacaggtcgacggacatccagwtgacccagtctcc

SEQ ID NO: 187 - DNA, 41 bp, Artificial sequence
  primer HuVkappa2-SalI
tgagcacacaggtcgacggatgttgtgatgactcagtctcc

SEQ ID NO: 188 - DNA, 41 bp, Artificial sequence
  primer HuVkappa3B-SalI
tgagcacacaggtcgacggaaattgtgwtgacrcagtctcc

SEQ ID NO: 189 - DNA, 41 bp, Artificial sequence
  primer HuVkappa4B-SalI
tgagcacacaggtcgacggatattgtgatgacccacactcc

SEQ ID NO: 190 - DNA, 41 bp, Artificial sequence
  primer HuVkappa5-SalI
tgagcacacaggtcgacggaaacgacactcacgcagtctcc

SEQ ID NO: 191 - DNA, 41 bp, Artificial sequence
  primer HuVkappa6-SalI
tgagcacacaggtcgacggaaattgtgctgactcagtctcc

SEQ ID NO: 192 - DNA, 48 bp, Artificial sequence
  primer HuJkappa1-NotI
gagtcattctcgacttgcggccgcacgtttgatttccaccttggtccc

SEQ ID NO: 193 - DNA, 48 bp, Artificial sequence
  primer HuJkappa2-NotI
gagtcattctcgacttgcggccgcacgtttgatctccagcttggtccc

SEQ ID NO: 194 - DNA, 48 bp, Artificial sequence
  primer HuJkappa3-NotI
gagtcattctcgacttgcggccgcacgtttgatatccactttggtccc

SEQ ID NO: 195 - DNA, 48 bp, Artificial sequence
  primer HuJkappa4-NotI
gagtcattctcgacttgcggccgcacgtttgatctccaccttggtccc

SEQ ID NO: 196 - DNA, 48 bp, Artificial sequence
  primer HuJkappa5-NotI
gagtcattctcgacttgcggccgcacgtttaatctccagtcgtgtccc

SEQ ID NO: 197 - DNA, 41 bp, Artificial sequence
  primer HuVlambda1A-SalI
tgagcacacaggtcgacgcagtctgtgctgactcagccacc

SEQ ID NO: 198 - DNA, 41 bp, Artificial sequence
  primer HuVlambda1B-SalI
tgagcacacaggtcgacgcagtctgtgytgacgcagccgcc

SEQ ID NO: 199 - DNA, 41 bp, Artificial sequence
  primer HuVlambda1C-SalI
tgagcacacaggtcgacgcagtctgtcgtgacgcagccgcc

SEQ ID NO: 200 - DNA, 39 bp, Artificial sequence
  primer HuVlambda2-SalI
tgagcacacaggtcgacgcartctgccctgactcagcct

SEQ ID NO: 201 - DNA, 41 bp, Artificial sequence
  primer HuVlambda3A-SalI
tgagcacacaggtcgacgtcctatgwgctgactcagccacc

SEQ ID NO: 202 - DNA, 41 bp, Artificial sequence
  primer HuVlambda3B-SalI
tgagcacacaggtcgacgtcttctgagctgactcaggaccc

SEQ ID NO: 203 - DNA, 41 bp, Artificial sequence
  primer HuVlambda4-SalI
tgagcacacaggtcgacgcacgttatactgactcaaccgcc

SEQ ID NO: 204 - DNA, 41 bp, Artificial sequence
  primer HuVlambda5-SalI
tgagcacacaggtcgacgcaggctgtgctgactcagccgtc

SEQ ID NO: 205 - DNA, 41 bp, Artificial sequence
  primer HuVlambda6-SalI
tgagcacacaggtcgacgaattttatgctgactcagcccca

SEQ ID NO: 206 - DNA, 41 bp, Artificial sequence
  primer HuVlambda7/8-SalI
tgagcacacaggtcgacgcagrctgtggtgacycaggagcc

SEQ ID NO: 207 - DNA, 41 bp, Artificial sequence
  primer HuVlambda9-SalI
tgagcacacaggtcgacgcwgcctgtgctgactcagccmcc

SEQ ID NO: 208 - DNA, 48 bp, Artificial sequence
  primer HuJlambda1-NotI
gagtcattctcgacttgcggccgcacctaggacggtgaccttggtccc

SEQ ID NO: 209 - DNA, 48 bp, Artificial sequence
  primer HuJlambda2/3-NotI
gagtcattctcgacttgcggccgcacctaggacggtcagcttggtccc

SEQ ID NO: 210 - DNA, 48 bp, Artificial sequence
  primer HuJlambda4/5-NotI
gagtcattctcgacttgcggccgcacytaaaacggtgagctgggtccc

SEQ ID NO: 211 - DNA, 753 bp, Artificial sequence
  CDS (1)..(753): SC03-019
gccatggcccagatgcagctggtgcagtctgggggaggcgtggtccagcctgggaggtccctgagactctcctgtgcagcctctggattcaccttcagtggctatgctatgcactgggtccgccaggctccaggcaaggggctggagtgggtggcagttatatcatatgatggaagcaataaatactacgcagactccgtgaagggccgattcgccatctccagagacaattccaagaacacgctgtatctgcaaatgaacagcctgagagctgaggacacggctgtgtattactgtgcgagattccctggtggtaccagaagccgcggctacatggacgtctggggcaaagggaccacggtcaccgtctcgagcggtacgggcggttcaggcggaaccggcagcggcactggcgggtcgacggaaattgtgctcacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctccggctttcggcggagggaccaaggtggagatcaaacgtgcggcc

SEQ ID NO: 212 - protein, 251 aa, Artificial sequence
  SC03-019
AMAQMQLVQSGGGVVQPGRSLRLSCAASGFTFSGYAMHWVRQAPGKGLEWVAVISYDGSNKYYADSVKGRFAISRDNSKNTLYLQMNSLRAEDTAVYYCARFPGGTRSRGYMDVWGKGTTVTVSSGTGGSGGTGSGTGGSTEIVLTQSPATLSLSPGERATLSCRASQSVSSYLAWYQQKPGQAPRLLIYDASNRATGIPARFSGSGSGTDFTLTISSLEPEDFAVYYCQQRSNWPPAFGGGTKVEIKRAA

SEQ ID NO: 213 - DNA, 762 bp, Artificial sequence
  CDS (1)..(762): SC03-020
gccatggccgaagtgcagctggtgcagtctgggtcagaggtgaaaaagccgggggagtctctgaagatctcttgtaagggttctggatacggctttatcacctactggatcggctgggtgcgccagatgcccgggaaaggcctggagtggatggggatcatctatcctggtgactctgaaaccagatacagcccgtccttccaaggccaggtcaccatctcagccgacaagtccatcaacaccgcctacctgcagtggagcagcctgaaggcctcggacaccgccatatattactgtgcggggggttcggggatttctacccctatggacgtctggggccaagggaccacggtcaccgtctcgagcggtacgggcggttcaggcggaaccggcagcggcactggcgggtcgacggacatccagatgacccagtctccagactccctggctgtgtctctgggcgagagggccaccatcaactgcaagtccagccagaaaattttacacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactcctccggttttcggcggagggaccaaggtggaaatcaaacgtgcggcc

SEQ ID NO: 214 - protein, 254 aa, Artificial sequence
  SC03-020
AMAEVQLVQSGSEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTVSSGTGGSGGTGSGTGGSTDIQMTQSPDSLAVSLGERATINCKSSQKILHSSNNKNYLAWYQQKPGQPPKLLIYWASTRESGVPDRFSGSGSGTDFTLTISSLQAEDVAVYYCQQYYSTPPVFGGGTKVEIKRAA

SEQ ID NO: 215 - DNA, 762 bp, Artificial sequence
  CDS (1)..(762): SC03-021
gccatggcccaggtccagctggtacagtctggaacagaggtgaaaaagccgggggagtctctgaagatctcctgtaagggttctggatacggctttatcacctactggatcggctgggtgcgccagatgcccgggaaaggcctggagtggatggggatcatctatcctggtgactctgaaaccagatacagcccgtccttccaaggccaggtcaccatctcagccgacaagtccatcaacaccgcctacctgcagtggagcagcctgaaggcctcggacaccgccatatattactgtgcggggggttcggggatttctacccctatggacgtctggggccaagggaccacggtcaccgtctcgagcggtacgggcggttcaggcggaaccggcagcggcactggcgggtcgacggatgttgtgatgactcagtctccagactccctggctgtgtctctgggcgagagggccaccatcaactgcaagtccagccagagtgttttacacagctccaacaataagaactacctagcttggtaccagcagaaaccaggacagcctcctaagctgctcatttactgggcatctacccggcaatccggggtccctgaccgattcagtggcagcgggtctgggacagatttcactctcaccatcagcagcctgcaggctgaagatgtggcagtttattactgtcagcaatattatagtactcctccgacgttcggccaagggaccaaggtggaaatcaaacgtgcggcc

SEQ ID NO: 216 - protein, 254 aa, Artificial sequence
  SC03-021
AMAQVQLVQSGTEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTVSSGTGGSGGTGSGTGGSTDVVMTQSPDSLAVSLGERATINCKSSQSVLHSSNNKNYLAWYQQKPGQPPKLLIYWASTRQSGVPDRFSGSGSGTDFTLTISSLQAEDVAVYYCQQYYSTPPTFGQGTKVEIKRAA

SEQ ID NO: 217 - DNA, 762 bp, Artificial sequence
  CDS (1)..(762): SC03-022
gccatggcccagatgcagctggtgcaatctggaacagaggtgaaaaagccgggggagtctctgaagatctcctgtaagggttctggatacggctttatcacctactggatcggctgggtgcgccagatgcccgggaaaggcctggagtggatggggatcatctatcctggtgactctgaaaccagatacagcccgtccttccaaggccaggtcaccatctcagccgacaagtccatcaacaccgcctacctgcagtggagcagcctgaaggcctcggacaccgccatatattactgtgcggggggttcggggatttctacccctatggacgtctggggccaagggaccacggtcaccgtctcgagcggtacgggcggttcaggcggaaccggcagcggcactggcgggtcgacggacatccagttgacccagtctccagactccctggctgtgtctctgggcgagagggccaccatcaactgcaagtccagccagagtgttttatacagctccatcaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactccgtacacttttggccaggggaccaaggtggaaatcaaacgtgcggcc

SEQ ID NO: 218 - protein, 254 aa, Artificial sequence
  SC03-022
AMAQMQLVQSGTEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTVSSGTGGSGGTGSGTGGSTDIQLTQSPDSLAVSLGERATINCKSSQSVLYSSINKNYLAWYQQKPGQPPKLLIYWASTRESGVPDRFSGSGSGTDFTLTISSLQAEDVAVYYCQQYYSTPYTFGQGTKVEIKRAA

SEQ ID NO: 219 - DNA, 780 bp, Artificial sequence
  CDS (1)..(780): SC03-023
gccatggcccaggtgcagctacagcagtggggcgcaggactgttgaagccttcggagaccctgtccctcacctgcgctgtctatggtgggtctttcagtggtttctactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagaagggtggaggtagtagagtaccagctgctccgtccccgatataaaagttggttcgacccctggggccagggcaccctggtcaccgtctcgagcggtacgggcggttcaggcggaaccggcagcggcactggcgggtcgacgcagtctgccctgactcagcctcgctcagtgtccgggtctcctggacagtcagtcaccatctcctgcactggatccagcagtactgttggtggttataactatgtctcctggtaccaacagcacccaggcaaagcccccaaactcatgatttatgatgtcagtaagcggccctcaggggtttctaatcgcttctctggctccaagtctggcaacacggcctccctgaccatctctgggctccaggctgaggacgaggctgattattactgcagctcatatacaagcagcagcacttatgtcttcggaactgggaccaaggtcaccgtcctaggtgcggcc

SEQ ID NO: 220 - protein, 260 aa, Artificial sequence
  SC03-023
AMAQVQLQQWGAGLLKPSETLSLTCAVYGGSFSGFYWSWIRQPPGKGLEWIGEINHSGSTNYNPSLKSRVTISVDTSKNQFSLKLSSVTAADTAVYYCARRVEVVEYQLLRPRYKSWFDPWGQGTLVTVSSGTGGSGGTGSGTGGSTQSALTQPRSVSGSPGQSVTISCTGSSSTVGGYNYVSWYQQHPGKAPKLMIYDVSKRPSGVSNRFSGSKSGNTASLTISGLQAEDEADYYCSSYTSSSTYVFGTGTKVTVLGAA

SEQ ID NO: 221 - DNA, 753 bp, Artificial sequence
  CDS (1)..(753): SC03-024
gccatggcccaggtgcagctggtggagtctgggtctgagttgaagatccctggggcctcagtgaaggtttcctgcaaggctactggatacaccttcactcgttattctctgaattgggtgcggcaggcccctggacaagggcttgagtgggtggggtggattaacacccagactggaaactcaaactatggccaggccttctcaggacggtttgtcttctccttggacacctcagtcagcacggcatatttgcaaatcagcagcctacaggccgaggacactgccacatactactgtgcgaggaagagtgcgggttcgaatgctttcgacatttggggccaagggacaatggtcaccgtctcgagcggtacgggcggttcaggcggaaccggcagcggcactggcgggtcgacgcagtctgtcgtgacgcagccgccctcagtgtctgcggccccaggacagaaggccaccatctcctgctctggaagcagctccaacattgggaataattatgtatcctggtaccagcagctcccaggaacagcccccaaactcctcatttatgacaataataagcgaccctcagggattcctaaccgattctctggctccaagtctggcacgtcagccaccctgggcatcaccggactccagactggggacgaggccgattattactgcggaacatgggatagcagcctgagtgcttatgtcttcggaactgggaccaaggtcaccgtcctaggtgcggcc

SEQ ID NO: 222 - protein, 251 aa, Artificial sequence
  SC03-024
AMAQVQLVESGSELKIPGASVKVSCKATGYTFTRYSLNWVRQAPGQGLEWVGWINTQTGNSNYGQAFSGRFVFSLDTSVSTAYLQISSLQAEDTATYYCARKSAGSNAFDIWGQGTMVTVSSGTGGSGGTGSGTGGSTQSVVTQPPSVSAAPGQKATISCSGSSSNIGNNYVSWYQQLPGTAPKLLIYDNNKRPSGIPNRFSGSKSGTSATLGITGLQTGDEADYYCGTWDSSLSAYVFGTGTKVTVLGAA

SEQ ID NO: 223 - DNA, 756 bp, Artificial sequence
  CDS (1)..(756): SC03-025
gccatggccgaggtgcagctggtggagtctgggggaggcttggtccagcctggggggtccctgagactctcctgtgcagcctctggattcaccttcagtagttatgctatgcactgggtccgccaggctccagggaagggactggaatatgtttcaggtattagtagtaatgggggtagcacatattatgcaaactctgtgaagggcagattcaccatctccagagacaattccaagaacacgctgtatcttcaaatgggcagcctgagagctgaggacatggctgtgtattactgtgcgagaactactaatcgggcttttgatatctggggccaagggacaatggtcaccgtctcgagcggtacgggcggttcaggcggaaccggcagcggcactggcgggtcgacggacatccagttgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattataatattccgtatgctttcggccaggggaccaagctggagatcaaacgtgcggcc

SEQ ID NO: 224 - protein, 252 aa, Artificial sequence
  SC03-025
AMAEVQLVESGGGLVQPGGSLRLSCAASGFTFSSYAMHWVRQAPGKGLEYVSGISSNGGSTYYANSVKGRFTISRDNSKNTLYLQMGSLRAEDMAVYYCARTTNRAFDIWGQGTMVTVSSGTGGSGGTGSGTGGSTDIQLTQSPDSLAVSLGERATINCKSSQSVLYSSNNKNYLAWYQQKPGQPPKLLIYWASIRESGVPDRFSGSGSGTDFTLTISSLQAEDVAVYYCQQYYNIPYAFGQGTKLEIKRAA

SEQ ID NO: 225 - DNA, 756 bp, Artificial sequence
  CDS (1)..(756): SC03-026
gccatggcccaggtccagctggtacagtctgggggaggcttggtccagcctggggggtccctgagactctcctgtgcagcctctggattcaccttcagtagttatgccatgcactgggtccgccaggctccagggaagggactggaatatgtttcaggtattagtagtaatgggggtagcacatattatgcaaactctgtgaagggcagattcaccatctccagagacaattccaagaacacgctgtatcttcaaatgggcagcctgagagctgaggacatggctgtgtattactgtgcgagaactactaatcgggcttttgatatctggggccaagggacaatggtcaccgtctcgagcggtacgggcggttcaggcggaaccggcagcggcactggcgggtcgacggacatccagatgacccagtctccagactccctggctgtgtctctgggcgagagggccaccatcaactgcaagtccagccagagtattttatacagctccaacagtaagaactacttaggttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactccgtacagttttggccaggggaccaaggtggagatcaaacgtgcggcc

SEQ ID NO: 226 - protein, 252 aa, Artificial sequence
  SC03-026
AMAQVQLVQSGGGLVQPGGSLRLSCAASGFTFSSYAMHWVRQAPGKGLEYVSGISSNGGSTYYANSVKGRFTISRDNSKNTLYLQMGSLRAEDMAVYYCARTTNRAFDIWGQGTMVTVSSGTGGSGGTGSGTGGSTDIQMTQSPDSLAVSLGERATINCKSSQSILYSSNSKNYLGWYQQKPGQPPKLLIYWASTRESGVPDRFSGSGSGTDFTLTISSLQAEDVAVYYCQQYYSTPYSFGQGTKVEIKRAA

SEQ ID NO: 227 - DNA, 756 bp, Artificial sequence
  CDS (1)..(756): SC03-027
gccatggcccaggtccagctggtgcagtctgggggaggcttggtccagcctggggggtccctgagactctcctgtgcagcctctggattcaccttcagtagttatgctatgcactgggtccgccaggctccagggaagggactggaatatgtttcaggtattagtagtaatgggggtagcacatattatgcaaactctgtgaagggcagattcaccatctccagagacaattccaagaacacgctgtatcttcaaatgggcagcctgagagctgaggacatggctgtgtattactgtgcgagaactactaatcgggcttttgatatctggggccaagggacaatggtcaccgtctcgagcggtacgggcggttcaggcggaaccggcagcggcactggcgggtcgacggacatccagatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactccgtacagttttggccaggggaccaaagtggatatcaaacgtgcggcc

SEQ ID NO: 228 - protein, 252 aa, Artificial sequence
  SC03-027
AMAQVQLVQSGGGLVQPGGSLRLSCAASGFTFSSYAMHWVRQAPGKGLEYVSGISSNGGSTYYANSVKGRFTISRDNSKNTLYLQMGSLRAEDMAVYYCARTTNRAFDIWGQGTMVTVSSGTGGSGGTGSGTGGSTDIQMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPYSFGQGTKVDIKRAA

SEQ ID NO: 229 - DNA, 756 bp, Artificial sequence
  CDS (1)..(756): SC03-029
gccatggccgaagtgcagctggtgcagtctgggggaggcttggttcagccgggggggtccctgagactctcctgtgcagcctctggattcaccttcagtagttatgctatgcactgggtccgccaggctccagggaagggactggaatatgtttcaggtattagtagtaatgggggtagcacatattatgcaaactctgtgaagggcagattcaccatctccagagacaattccaagaacacgctgtatcttcaaatgggcagcctgagagctgaggacatggctgtgtattactgtgcgagaactactaatcgggcttttgatatctggggccaagggacaatggtcaccgtctcgagcggtacgggcggttcaggcggaaccggcagcggcactggcgggtcgacggacatccagatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactcctctcactttcggcgcagggaccaagctggagatcaaacgtgcggcc

SEQ ID NO: 230 - protein, 252 aa, Artificial sequence
  SC03-029
AMAEVQLVQSGGGLVQPGGSLRLSCAASGFTFSSYAMHWVRQAPGKGLEYVSGISSNGGSTYYANSVKGRFTISRDNSKNTLYLQMGSLRAEDMAVYYCARTTNRAFDIWGQGTMVTVSSGTGGSGGTGSGTGGSTDIQMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPLTFGAGTKLEIKRAA

SEQ ID NO: 231 - DNA, 756 bp, Artificial sequence
  CDS (1)..(756): SC03-030
gccatggcggaggtccaggtggtacagtctggaggaggcttggtccagcctggggggtccctcaaactctcctgtgcagcctctggattcaccttcagtagttatgctatgcactgggtccgccaggctccagggaagggactggaatatgtttcaggtattagtagtaatgggggtagcacatattatgcaaactctgtgaagggcagattcaccatctccagagacaattccaagaacacgctgtatcttcaaatgggcagcctgagagctgaggacatggctgtgtattactgtgcgagaactactaatcgggcttttgatatctggggccaagggacaatggtcaccgtctcgagcggtacgggcggttcaggcggaaccggcagcggcactggcgggtcgacggacatccagatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagattttactctcaccatcagcagtctgcaggctgaagatgtggcagtttattactgtcagcaatattatagtactcctctgacgttcggccaagggaccaaggtggaaatcaaacgtgcggcc

SEQ ID NO: 232 - protein, 252 aa, Artificial sequence
  SC03-030
AMAEVQVVQSGGGLVQPGGSLKLSCAASGFTFSSYAMHWVRQAPGKGLEYVSGISSNGGSTYYANSVKGRFTISRDNSKNTLYLQMGSLRAEDMAVYYCARTTNRAFDIWGQGTMVTVSSGTGGSGGTGSGTGGSTDIQMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPLTFGQGTKVEIKRAA

SEQ ID NO: 233 - DNA, 759 bp, Artificial sequence
  CDS (1)..(759): SC03-031
gccatggcccaggtgcagctggtgcaatctggggctgacgtgaagaagcctgggtcctcggtgaaggtctcctgcgaggcttctggaggcacgttcagcagctatgctatcagctgggtgcgacaggcccctggacaagggcttgagtggatgggaaggatcatccctatccttggtataacaaactacgcacagaagttccagggcagagtcacaattaccgcggacaaatccacgggcacaggcaacatggagctgagcagcctgagatctgaggacacggccgtgtattactgtgcgagagaatcgggtggtggctacgataaccactttgactactggggccagggaaccctggtcaccgtctcgagcggtacgggcggttcaggcggaaccggcagcggcactggcgggtcgacgcagtctgtgctgacgcagccgccctcagcgtctgggacccccggacagagggtcaccatctcttgttctggaggcagctccaacatcggaagtaatactgtaaactggtaccagcaactcccaggaacggcccccaaactcgtcatctatgctaataatcagcggccctcaggggtccctgaccgattctctgcctccaagtctggcacctcagcctccctggccatcagtgggctccagtctgaggatgaggctgattattactgtgcagcttgggatgacagcctgactggtggagtgttcggcggagggacccagctcaccgttttaagtgcggcc

SEQ ID NO: 234 - protein, 253 aa, Artificial sequence
  SC03-031
AMAQVQLVQSGADVKKPGSSVKVSCEASGGTFSSYAISWVRQAPGQGLEWMGRIIPILGITNYAQKFQGRVTITADKSTGTGNMELSSLRSEDTAVYYCARESGGGYDNHFDYWGQGTLVTVSSGTGGSGGTGSGTGGSTQSVLTQPPSASGTPGQRVTISCSGGSSNIGSNTVNWYQQLPGTAPKLVIYANNQRPSGVPDRFSASKSGTSASLAISGLQSEDEADYYCAAWDDSLTGGVFGGGTQLTVLSAA

SEQ ID NO: 235 - DNA, 771 bp, Artificial sequence
  CDS (1)..(771): SC03-032
gccatggccgaggtgcagctggtggagtctggggctgaggtgaagaagcctgggtcctcggtgaaggtctcctgcaaggcttctggaggcaccttcagcagctatgctatcagctgggtgcgacaggcccctggacaagggcttgagtggatgggaaagatcatccctattcttggtaaagtcacttacgcacagaagttccaggccagagtcacgattaccgcggacgaatccacgagcacagcctacctggagctgagcagcctgagatctgaggacacggccgttttttactgtgcgagagacggctgggatttgactggttcttttttaggctacggtatggacgtctggggccaagggaccacggtcaccgtctcgagcggtacgggcggttcaggcggaaccggcagcggcactggcgggtcgacgcagtctgtcgtgacgcagccgccctcagcgtctgggacccccgggcagagggtcaccatctcttgttctggaagcagctccaacatcggaagtaatactgtaagctggtaccagcaggttccagggacggcccccaagctcctcatctataggaataatcagcggcccccaggggtccytgaccgattctctggctccaagtctggcacctcagcctccytggccatcagtgggctccagtctgacgatgaggccttttattactgtgcagcatgggatggcagcmtgaatggtctggccttcggcggagggaccaagctgaccgtcctaggtgcggcc

SEQ ID NO: 236 - protein, 257 aa, Artificial sequence
  misc_feature (204)..(204): The 'Xaa' at location 204 stands for Pro, or Leu.
  misc_feature (218)..(218): The 'Xaa' at location 218 stands for Leu.
  misc_feature (240)..(240): The 'Xaa' at location 240 stands for Met, or Leu.
  SC03-032
AMAEVQLVESGAEVKKPGSSVKVSCKASGGTFSSYAISWVRQAPGQGLEWMGKIIPILGKVTYAQKFQARVTITADESTSTAYLELSSLRSEDTAVFYCARDGWDLTGSFLGYGMDVWGQGTTVTVSSGTGGSGGTGSGTGGSTQSVVTQPPSASGTPGQRVTISCSGSSSNIGSNTVSWYQQVPGTAPKLLIYRNNQRPPGVXDRFSGSKSGTSASXAISGLQSDDEAFYYCAAWDGSXNGLAFGGGTKLTVLGAA

SEQ ID NO: 237 - DNA, 765 bp, Artificial sequence
  CDS (1)..(765): SC03-033
gccatggcccaggtccagctggtacagtctggaacagaggtgaaaaagccgggggagtctctgaagatctcctgtaagggttctggatacggctttatcacctactggatcggctgggtgcgccagatgcccgggaaaggcctggagtggatggggatcatctatcctggtgactctgaaaccagatacagcccgtccttccaaggccaggtcaccatctcagccgacaagtccatcaacaccgcctacctgcagtggagcagcctgaaggcctcggacaccgccatatattactgtgcggggggttcggggatttctacccctatggacgtctggggccaagggaccacggtcaccgtctcgagcggtacgggcggttcaggcggaaccggcagcggcactggcgggtcgacggatgttgtgatgactcagtctccagactccctggctgtgtctctgggcgagagggccaccatcaactgcaagaccagccacaatattttctccagatccaacaataaggactacttagcttggtaccagcagaaaccaggccagcctcccagattactcatttactgggcgtctacccgggcatccggggtccctgaacgattcagtggcagcggctctgggacagacttcagtctcaccatcagcagcctgcaggctgaagatgtggcggtttattactgtcagcaatattatagttcccctatgtacagttttggccaggggaccaaggtggagatcaaacgtgcggcc

SEQ ID NO: 238 - protein, 255 aa, Artificial sequence
  SC03-033
AMAQVQLVQSGTEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTVSSGTGGSGGTGSGTGGSTDVVMTQSPDSLAVSLGERATINCKTSHNIFSRSNNKDYLAWYQQKPGQPPRLLIYWASTRASGVPERFSGSGSGTDFSLTISSLQAEDVAVYYCQQYYSSPMYSFGQGTKVEIKRAA

SEQ ID NO: 239 - DNA, 762 bp, Artificial sequence
  CDS (1)..(762): SC03-034
gccatggccgaggtgcagctggtgcagtctggagcagaggtgaaaaagccgggggagtctctgaagatctcctgtaagggttctggatacggctttatcacctactggatcggctgggtgcgccagatgcccgggaaaggcctggagtggatggggatcatctatcctggtgactctgaaaccagatacagcccgtccttccaaggccaggtcaccatctcagccgacaagtccatcaacaccgcctacctgcagtggagcagcctgaaggcctcggacaccgccatatattactgtgcggggggttcggggatttctacccctatggacgtctggggccaagggaccacggtcaccgtctcgagcggtacgggcggttcaggcggaaccggcagcggcactggcgggtcgacggatgttgtgatgactcagtctccagactccctggctgtgtctctgggcgagagggccaccatcaactgcaagtccagccagagtattttaaacagatccaacaataagaactacttagcttggtaccagcagaaaccaggacagcctcctaagctgctcatttactgggcatctacccgggaatccggggtccctgaccgattcagtggcagcgggtctgggacagatttcaatctcaccatcagcagcctgcaggctgaggatgtggcagtttattactgtcagcagtataataactggcctctcactttcggcggagggaccaaagtggatatcaaacgtgcggcc

SEQ ID NO: 240 - protein, 254 aa, Artificial sequence
  SC03-034
AMAEVQLVQSGAEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTVSSGTGGSGGTGSGTGGSTDVVMTQSPDSLAVSLGERATINCKSSQSILNRSNNKNYLAWYQQKPGQPPKLLIYWASTRESGVPDRFSGSGSGTDFNLTISSLQAEDVAVYYCQQYNNWPLTFGGGTKVDIKRAA

SEQ ID NO: 241 - DNA, 765 bp, Artificial sequence
  CDS (1)..(765): SC03-035
gccatggccgaggtgcagctggtgcagtctggagcagaggtgaaaaagcccggggagtctctgaagatctcctgtaagggttctggatacggctttatcacctactggatcggctgggtgcgccagatgcccgggaaaggcctggagtggatggggatcatctatcctggtgactctgaaaccagatacagcccgtccttccaaggccaggtcaccatctcagccgacaagtccatcaacaccgcctacctgcagtggagcagcctgaaggcctcggacaccgccatatattactgtgcggggggttcggggatttctacccctatggacgtctggggccaagggaccacggtcaccgtctcgagcggtacgggcggttcaggcggaaccggcagcggcactggcgggtcgacggacatccagatgacccagtctccagactccctggctgtgtctctgggcgagagggccaccatcaactgcaagtccagtcagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactcccctgtacagttttggccaggggaccaaggtggagatcaaacctgcggcc

SEQ ID NO: 242 - protein, 255 aa, Artificial sequence
  SC03-035
AMAEVQLVQSGAEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTVSSGTGGSGGTGSGTGGSTDIQMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPLYSFGQGTKVEIKPAA

SEQ ID NO: 243 - DNA, 759 bp, Artificial sequence
  CDS (1)..(759): SC03-036
gccatggccgaggtgcagctggtgcagtctggaacagaggtgaaaaagccgggggagtctctgaagatctcctgtaagggttctggatacggctttatcacctactggatcggctgggtgcgccagatgcccgggaaaggcctggagtggatggggatcatctatcctggtgactctgaaaccagatacagcccgtccttccaaggccaggtcaccatctcagccgacaagtccatcaacaccgcctacctgcagtggagcagcctgaaggcctcggacaccgccatatattactgtgcggggggttcggggatttctacccctatggacgtctggggccaagggaccacggtcaccgtctcgagcggtacgggcggttcaggcggaaccggcagcggcactggcgggtcgacggacatccagatgacccagtctccagactccctggctgtgtctctgggcgagagggccaccatcaactgcaagtccagccagagtgttttacacagccccaacaataagaactacttggcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactaacagttttggccaggggaccaagctggagatcaaacgtgcggcc

SEQ ID NO: 244 - protein, 253 aa, Artificial sequence
  SC03-036
AMAEVQLVQSGTEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTVSSGTGGSGGTGSGTGGSTDIQMTQSPDSLAVSLGERATINCKSSQSVLHSPNNKNYLAWYQQKPGQPPKLLIYWASTRESGVPDRFSGSGSGTDFTLTISSLQAEDVAVYYCQQYYSTNSFGQGTKLEIKRAA

SEQ ID NO: 245 - DNA, 744 bp, Artificial sequence
  CDS (1)..(744): SC03-037
gccatggccaaagtgcagctggtgcagtctggaggaggcttgatccagcctggggggtccctgagactctcctgtgcagcctctggattcaccgtcagtagcaactacatgagctgggtccgccaggctccagggaaggggctggagtgggtctcaattgtttttagcggtggtagcacatactacgcagactccgtgaagggccgattcaccatctccagagacaattccaagaacacgctgtatcttcaaatgaacagcctgagagccgaggacacggccgtatattattgtgcgagagatgcccaccgggggttcggtatggacgtctggggccaagggaccacggtcaccgtctcgagcggtacgggcggttcaggcggaaccggcagcggcactggcgggtcgacgtcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggcaaaaacaaccggccctcagggatcccagaccggttctctggctccagctcaggaaacacagcttccttgaccatcactggggctcaggcggaagatgaggccgactattattgtaacggccgggacagcagtggtaaccattgggtgttcggcggagggaccaagctgaccgtcctaggtgcggcc

SEQ ID NO: 246 - protein, 248 aa, Artificial sequence
  SC03-037
AMAKVQLVQSGGGLIQPGGSLRLSCAASGFTVSSNYMSWVRQAPGKGLEWVSIVFSGGSTYYADSVKGRFTISRDNSKNTLYLQMNSLRAEDTAVYYCARDAHRGFGMDVWGQGTTVTVSSGTGGSGGTGSGTGGSTSSELTQDPAVSVALGQTVRITCQGDSLRSYYASWYQQKPGQAPVLVIYGKNNRPSGIPDRFSGSSSGNTASLTITGAQAEDEADYYCNGRDSSGNHWVFGGGTKLTVLGAA

SEQ ID NO: 247 - DNA, 744 bp, Artificial sequence
  CDS (1)..(744): SC03-038
gccatggccgaggtgcagctggtgcagtctggaggaggcttgatccagcctggggggtccctgagactctcctgtgcagcctctgggttcaccgtcagtagcaactacatgagctgggtccgccaggctccagggaaggggctggagtgggtctcaattgtttttagcggtggtagcacatactacgcagactccgtgaagggccgattcaccatctccagagacaattccaagaacacgctgtatcttcaaatgaacagcctgagagccgaggacacggccgtatattattgtgcgagagatgcccatcgggggttcggtatggacgtctggggccaggggaccacggtcaccgtctcgagcggtacgggcggttcaggcggaaccggcagcggcactggcgggtcgacgtcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggagacacagcttccttgaccatcactggggctcaggcggaagatgaggctgactattactgtaactcccgggacagcagtggtaaccattgggtgttcggcggagggaccaagctgaccgtcctaggtgcggcc

SEQ ID NO: 248 - protein, 248 aa, Artificial sequence
  SC03-038
AMAEVQLVQSGGGLIQPGGSLRLSCAASGFTVSSNYMSWVRQAPGKGLEWVSIVFSGGSTYYADSVKGRFTISRDNSKNTLYLQMNSLRAEDTAVYYCARDAHRGFGMDVWGQGTTVTVSSGTGGSGGTGSGTGGSTSSELTQDPAVSVALGQTVRITCQGDSLRSYYASWYQQKPGQAPVLVIYGKNNRPSGIPDRFSGSSSGDTASLTITGAQAEDEADYYCNSRDSSGNHWVFGGGTKLTVLGAA

SEQ ID NO: 249 - DNA, 759 bp, Artificial sequence
  CDS (1)..(759): SC03-039
gccatggccgaggtgcagctggtggagtctgggggaggcttggtacagcctggggggtccctgagactctcctgtgcagcctctggattcacctttagcagctatgccatgagctgggtccgccaggctccagggaaggggctggagtgggtctcagttatttatagcggtggtactagtacatactatgcagactccgtgaagggccggttcaccatctccagagataattccaagaacacactgtatctgcaaatgaacagcctgagagccgaggacacggccgtatatttctgtgcgaaaggatctaaatggaacgacgtgggggggggtgactactggggccagggaaccctggtcaccgtctcgagcggtacgggcggttcaggcggaaccggcagcggcactggcgggtcgacgaattttatgctgactcagccccactctgtgtcggagtctccggggaagacggtaaccatctcctgcgccggcagcagtggcagcattgccagcaactatgtgcagtggtaccagcaacgcccgggcagtgcccccactactgtgatctatgaggataaccaaagaccctctggggtccctgatcggttctctggctccatcgacagctcctccaactctgcctccctcaccatctctggactgaagactgaggacgaggctgactactactgtcagtcttatgatggttatctttggattttcggcggagggaccaagctgaccgtcctaggtgcggcc

SEQ ID NO: 250 - protein, 253 aa, Artificial sequence
  SC03-039
AMAEVQLVESGGGLVQPGGSLRLSCAASGFTFSSYAMSWVRQAPGKGLEWVSVIYSGGTSTYYADSVKGRFTISRDNSKNTLYLQMNSLRAEDTAVYFCAKGSKWNDVGGGDYWGQGTLVTVSSGTGGSGGTGSGTGGSTNFMLTQPHSVSESPGKTVTISCAGSSGSIASNYVQWYQQRPGSAPTTVIYEDNQRPSGVPDRFSGSIDSSSNSASLTISGLKTEDEADYYCQSYDGYLWIFGGGTKLTVLGAA

SEQ ID NO: 251 - DNA, 756 bp, Artificial sequence
  CDS (1)..(756): SC03-040
gccatggcccaggtccagctggtacagtctgggggaggcttggtccagcctggggggtccctgagactctcctgtgcagcctctggattcaccttcagtagttatgctatgcactgggtccgccaggctccagggaagggactggaatatgtttcaggtattagtagtaatgggggtagcacatattatgcaaactctgtgaagggcagattcaccatctccagagacaattccaagaacacgctgtatcttcaaatgggcagcctgagagctgaggacatggctgtgtattactgtgcgagaactactaatcgggcttttgatatctggggccaagggacaatggtcaccgtctcgagcggtacgggcggttcaggcggaaccggcagcggcactggcgggtcgacggacatccagatgacccagtctccagactccctggctgtgtctctgggcgagagggccaccatcaactgcaggtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtagtccgtacagttttggccaggggaccaagctggagatcaaacgtgcggcc

SEQ ID NO: 252 - protein, 252 aa, Artificial sequence
  SC03-040
AMAQVQLVQSGGGLVQPGGSLRLSCAASGFTFSSYAMHWVRQAPGKGLEYVSGISSNGGSTYYANSVKGRFTISRDNSKNTLYLQMGSLRAEDMAVYYCARTTNRAFDIWGQGTMVTVSSGTGGSGGTGSGTGGSTDIQMTQSPDSLAVSLGERATINCRSSQSVLYSSNNKNYLAWYQQKPGQPPKLLIYWASTRESGVPDRFSGSGSGTDFTLTISSLQAEDVAVYYCQQYYSSPYSFGQGTKLEIKRAA

SEQ ID NO: 253 - DNA, 756 bp, Artificial sequence
  CDS (1)..(756): SC03-041
gccatggcccaggtccagctggtgcagtctgggggaggcttggtccagcctggggggtccctgagactctcctgtgcagcctctggattcaccttcagtagttatgctatgcactgggtccgccaggctccagggaagggactggaatatgtttcaggtattagtagtaatgggggtagcacatattatgcaaactctgtgaagggcagattcaccatctccagagacaattccaagaacacgctgtatcttcaaatgggcagcctgagagctgaggacatggctgtgtattactgtgcgagaactactaatcgggcttttgatatctggggccaagggacaatggtcaccgtctcgagcggtacgggcggttcaggcggaaccggcagcggcactggcgggtcgacggatatccagatgacccagtctccagactccctggctgtgtctctgggcgagcggaccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactccgtacagttttggccaggggaccaagctggagatcaaacgtgcggcc

SEQ ID NO: 254 - protein, 252 aa, Artificial sequence
  SC03-041
AMAQVQLVQSGGGLVQPGGSLRLSCAASGFTFSSYAMHWVRQAPGKGLEYVSGISSNGGSTYYANSVKGRFTISRDNSKNTLYLQMGSLRAEDMAVYYCARTTNRAFDIWGQGTMVTVSSGTGGSGGTGSGTGGSTDIQMTQSPDSLAVSLGERTTINCKSSQSVLYSSNNKNYLAWYQQKPGQPPKLLIYWASTRESGVPDRFSGSGSGTDFTLTISSLQAEDVAVYYCQQYYSTPYSFGQGTKLEIKRAA

SEQ ID NO: 255 - DNA, 756 bp, Artificial sequence
  misc_feature (153)..(154): n can be a, g, c or t
  CDS (1)..(756): SC03-042
gccatggcccagatgcagctggtgcaatctgggggaggcttagttcagcctggggggtccctgagactttcctgtgcagcctctggattcaccttcagtagttatgctatgcactgggtccgccaggctccagggaagggactggaatatgtntcaggtattagtagtaatgggggtagcacatattatgcaaactctgtgaagggcagattcaccatctccagagacaattccaagaacacgctgtatcttcaaatgggcagcctgagagctgaggacatggctgtgtattactgtgcgagaactactaatcgggcttttgatatctggggccaagggacaatggtcaccgtctcgagcggtacgggcggttcaggcggaaccggcagcggcactggcgggtcgacggatgttgtgatgactcagtctccagactccctggctgtgtctctgggcgagagggccaccatcaactgcaagtccagccagagtgttttatacagctccaacgataagaactacttagcttggtaccagcagaaaccaggacagcctcctaagctgctcatttactgggcatctacccgggaatccggggtccctgaccgattcagcggcagcgggtctgggacagatttcactctcaccatcagcagcctgcaggctgaagatgtggcagtttattactgtcagcaatattatagtactccgtacagttttggccaggggaccaagctggagatcaaacgtgcggcc

SEQ ID NO: 256 - protein, 252 aa, Artificial sequence
  SC03-042
  misc_feature (153)..(154): n can be a, g, c or t
AMAQMQLVQSGGGLVQPGGSLRLSCAASGFTFSSYAMHWVRQAPGKGLEYVSGISSNGGSTYYANSVKGRFTISRDNSKNTLYLQMGSLRAEDMAVYYCARTTNRAFDIWGQGTMVTVSSGTGGSGGTGSGTGGSTDVVMTQSPDSLAVSLGERATINCKSSQSVLYSSNDKNYLAWYQQKPGQPPKLLIYWASTRESGVPDRFSGSGSGTDFTLTISSLQAEDVAVYYCQQYYSTPYSFGQGTKLEIKRAA

SEQ ID NO: 257 - DNA, 756 bp, Artificial sequence
  CDS (1)..(756): SC03-043
gccatggcccaggtccagctggtgcagtctgggggaggcttggtccagcctggggggtccctgagactctcctgtgcagcctctggattcaccttcagtagttatgctatgcactgggtccgccaggctccagggaagggactggaatatgtttcaggtattagtagtaatgggggtagcacatattatgcaaactctgtgaagggcagattcaccatctccagagacaattccaagaacacgctgtatcttcaaatgggcagcctgagagctgaggacatggctgtgtattactgtgcgagaactactaatcgggcttttgatatctggggccaagggacaatggtcaccgtctcgagcggtacgggcggttcaggcggaaccggcagcggcactggcgggtcgacggacatccagttgacccagtctccagactccctggctgtgtctctgggcgagagggccaccatcaactgcaagtccagccagagtgttttatacaggtccaacaataagaactacttagcttggtaccagcagaagccaggacagcctcctaagctgctcatttactgggcatctacccgtgaatccggggtctctgagcgattcagtggcagcgggtctgggacagatttcactctcaccatcagcagcctgcaggctgaagatgtggcagtttattactgtcagcaatattatagtaccccgtacagttttggccaggggaccaagctggagatcaaacgtgcggcc

SEQ ID NO: 258 - protein, 252 aa, Artificial sequence
  SC03-043
AMAQVQLVQSGGGLVQPGGSLRLSCAASGFTFSSYAMHWVRQAPGKGLEYVSGISSNGGSTYYANSVKGRFTISRDNSKNTLYLQMGSLRAEDMAVYYCARTTNRAFDIWGQGTMVTVSSGTGGSGGTGSGTGGSTDIQLTQSPDSLAVSLGERATINCKSSQSVLYRSNNKNYLAWYQQKPGQPPKLLIYWASTRESGVSERFSGSGSGTDFTLTISSLQAEDVAVYYCQQYYSTPYSFGQGTKLEIKRAA

SEQ ID NO: 259 - DNA, 756 bp, Artificial sequence
  CDS (1)..(756): SC03-044
gccatggccgaggtgcagctggtggagactgggggaggcttggtccagcctggggggtccctgagactctcctgtgcagcctctggattcaccttcagtagttatgctatgcactgggtccgccaggctccagggaagggactggaatatgtttcaggtattagtagtaatgggggtagcacatattatgcaaactctgtgaagggcagattcaccatctccagagacaattccaagaacacgctgtatcttcaaatgggcagcctgagagctgaggacatggctgtgtattactgtgcgagaactactaatcgggcttttgatatctggggccaagggacaatggtcaccgtctcgagcggtacgggcggttcaggcggaaccggcagcggcactggcgggtcgacggacatccagatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcaggggcagcgggtccgggacagatttcactctcaccatcagcagcctgcaggctgaagatctggcagtttattactgtcagcaatattatagtactccgtacagttttggccaggggaccaagctggagatcaaacgtgcggcc

SEQ ID NO: 260 - protein, 252 aa, Artificial sequence
  SC03-044
AMAEVQLVETGGGLVQPGGSLRLSCAASGFTFSSYAMHWVRQAPGKGLEYVSGISSNGGSTYYANSVKGRFTISRDNSKNTLYLQMGSLRAEDMAVYYCARTTNRAFDIWGQGTMVTVSSGTGGSGGTGSGTGGSTDIQMTQSPDSLAVSLGERATINCKSSQSVLYSSNNKNYLAWYQQKPGQPPKLLIYWASTRESGVPDRFRGSGSGTDFTLTISSLQAEDLAVYYCQQYYSTPYSFGQGTKLEIKRAA

SEQ ID NO: 261 - DNA, 756 bp, Artificial sequence
  CDS (1)..(756): SC03-045
gccatggcccagctgcagctgcaggagtcggggggaggcttggtccagcctggggggtccctgagactctcctgtgcagcctctggattcaccttcagtagttatgctatgcactgggtccgccaggctccagggaagggactggaatatgtttcaggtattagtagtaatgggggtagtacatattatgcaaactctgtgaagggcagattcaccatctccagagacaattccaagaacacgctgtatcttcaaatgggcagcctgagagctgaggacatggctgtgtattactgtgcgagaactactaatcgggcttttgatatctggggccaggggacaatggtcaccgtctcgagcggtacgggcggttcaggcggaaccggcagcggcactggcgggtcgacggacatccagctgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactccattcactttcggccctgggaccaaagtggatatcaaacgtgcggcc

SEQ ID NO: 262 - protein, 252 aa, Artificial sequence
  SC03-045
AMAQLQLQESGGGLVQPGGSLRLSCAASGFTFSSYAMHWVRQAPGKGLEYVSGISSNGGSTYYANSVKGRFTISRDNSKNTLYLQMGSLRAEDMAVYYCARTTNRAFDIWGQGTMVTVSSGTGGSGGTGSGTGGSTDIQLTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPFTFGPGTKVDIKRAA

SEQ ID NO: 263 - DNA, 756 bp, Artificial sequence
  CDS (1)..(756): SC03-046
gccatggccgaggtccagctggtacagtctgggggaggcttggtccagcctggggggtccctgagactctcctgtgcagcctctggattcaccttcagtagttatgctatgcactgggtccgccaggctccagggaagggactggaatatgtttcaggtattagtagtaatgggggtagcacatattatgcaaactctgtgaagggcagattcaccatctccagagacaattccaagaacacgctgtatcttcaaatgggcagcctgagagctgaggacatggctgtgtattactgtgcgagaactactaatcgggcttttgatatctggggccaagggacaatggtcaccgtctcgagcggtacgggcggttcaggcggaaccggcagcggcactggcgggtcgacggatgttgtgatgactcagtctccagactccctggctgtgtctctgggcgagagggccaccatcaactgcaagtccagccagagtgttttatacagctccaacaataagaactacttagcttggtaccagcagaaaccagggcagcctcctaagctgctcatttactgggcatctacccgggaatccggggtccctgacaggttcagtggcagcgggtctgggacagacttcagtctcaccatcagcagcctgcaggctgaagatgtggcggtttattactgtcagcaatattacagtcctccgtacacttttggcccggggaccaaggtggaaatcaaacgtgcggcc

SEQ ID NO: 264 - protein, 252 aa, Artificial sequence
  SC03-046
AMAEVQLVQSGGGLVQPGGSLRLSCAASGFTFSSYAMHWVRQAPGKGLEYVSGISSNGGSTYYANSVKGRFTISRDNSKNTLYLQMGSLRAEDMAVYYCARTTNRAFDIWGQGTMVTVSSGTGGSGGTGSGTGGSTDVVMTQSPDSLAVSLGERATINCKSSQSVLYSSNNKNYLAWYQQKPGQPPKLLIYWASTRESGVPDRFSGSGSGTDFSLTISSLQAEDVAVYYCQQYYSPPYTFGPGTKVEIKRAA

SEQ ID NO: 265 - DNA, 756 bp, Artificial sequence
  CDS (1)..(756): SC03-047
gccatggccgaggtgcagctggtgcagtctgggggaggcttggtccagcctggggggtccctgagactctcctgtgcagcctctggattcaccttcagtagttatgctatgcactgggtccgccaggctccagggaagggactggaatatgtttcaggtattagtagtaatgggggtagcacatattatgcaaactctgtgaagggcagattcaccatctccagagacaattccaagaacacgctgtatcttcaaatgggcagcctgagagctgaggacatggctgtgtattactgtgcgagaactactaatcgggcttttgatatctggggccaggggacaatggtcaccgtctcgagcggtacgggcggttcaggcggaaccggcagcggcactggcgggtcgacggatgttgtgatgactcagtctccagactccctggctgtgtctctgggcgagagggccaccatcaactgcaagtccagccagagtgttttatatagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactcctctcactttcggcggagggaccaaggtggaaatcaaacgtgcggcc

SEQ ID NO: 266 - protein, 252 aa, Artificial sequence
  SC03-047
AMAEVQLVQSGGGLVQPGGSLRLSCAASGFTFSSYAMHWVRQAPGKGLEYVSGISSNGGSTYYANSVKGRFTISRDNSKNTLYLQMGSLRAEDMAVYYCARTTNRAFDIWGQGTMVTVSSGTGGSGGTGSGTGGSTDVVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPLTFGGGTKVEIKRAA

SEQ ID NO: 267 - DNA, 756 bp, Artificial sequence
  CDS (1)..(756): SC03-048
gccatggccgaggtgcagctggtggagactgggggaggcttggtccagcctggggggtccctgagactctcctgtgcagcctctggattcaccttcagtagttatgctatgcactgggtccgccaggctccagggaagggactggaatatgtttcaggtattagtagtaatgggggtagcacatattatgcaaactctgtgaagggcagattcaccatctccagagacaattccaagaacacgctgtatcttcaaatgggcagcctgagagctgaggacatggctgtgtattactgtgcgagaactactaatcgggcttttgatatctggggccaagggacaatggtcaccgtctcgagcggtacgggcggttcaggcggaaccggcagcggcactggcgggtcgacggacatccagttgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattacagtactccgctcactttcggcggagggaccaaggtggaaatcaaacgtgcggcc

SEQ ID NO: 268 - protein, 252 aa, Artificial sequence
  SC03-048
AMAEVQLVETGGGLVQPGGSLRLSCAASGFTFSSYAMHWVRQAPGKGLEYVSGISSNGGSTYYANSVKGRFTISRDNSKNTLYLQMGSLRAEDMAVYYCARTTNRAFDIWGQGTMVTVSSGTGGSGGTGSGTGGSTDIQLTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPLTFGGGTKVEIKRAA

SEQ ID NO: 269 - DNA, 756 bp, Artificial sequence
  CDS (1)..(756): SC03-049
gccatggcccaggtgcagctggtgcagtctgggggaggcttggtccagcctggggggtccctgagactctcctgtgcagcctctggattcaccttcagtagttatgctatgcactgggtccgccaggctccagggaagggactggaatatgtttcaggtattagtagtaatgggggtagcacatattatgcaaactctgtgaagggcagattcaccatctccagagacaattccaagaacacgctgtatcttcaaatgggcagcctgagagctgaggacatggctgtgtattactgtgcgagaactactaatcgggcttttgacatctggggccaagggacaatggtcaccgtctcgagcggtacgggcggttcaggcggaaccggcagcggcactggcgggtcgacggacatccagttgacccagtctccatcctccctggctgtgtctctgggcgagagggccaccatcaactgcaagtccagccagagtgttttatacagctccaacaataagaactacttagcttggtatcagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactccgctcactttcggcggagggaccaaggtggagatcaaacgtgcggcc

SEQ ID NO: 270 - protein, 252 aa, Artificial sequence
  SC03-049
AMAQVQLVQSGGGLVQPGGSLRLSCAASGFTFSSYAMHWVRQAPGKGLEYVSGISSNGGSTYYANSVKGRFTISRDNSKNTLYLQMGSLRAEDMAVYYCARTTNRAFDIWGQGTMVTVSSGTGGSGGTGSGTGGSTDIQLTQSPSSLAVSLGERATINCKSSQSVLYSSNNKNYLAWYQQKPGQPPKLLIYWASTRESGVPDRFSGSGSGTDFTLTISSLQAEDVAVYYCQQYYSTPLTFGGGTKVEIKRAA

SEQ ID NO: 271 - DNA, 756 bp, Artificial sequence; identical to SEQ ID NO: 269
  CDS (1)..(756): SC03-050

SEQ ID NO: 272 - protein, 252 aa, Artificial sequence; identical to SEQ ID NO: 270
  SC03-050

SEQ ID NO: 273 - DNA, 762 bp, Artificial sequence
  CDS (1)..(762): SC03-051
gccatggcccaggtgcagctggtgcagtctggaacagaggtgaaaaagccgggggagtctctgaagatctcctgtaagggttctggatacggctttatcacctactggatcggctgggtgcgccagatgcccgggaaaggcctggagtggatggggatcatctatcctggtgactctgaaaccagatacagcccgtccttccaaggccaggtcaccatctcagccgacaagtccatcaacaccgcctacctgcagtggagcagcctgaaggcctcggacaccgccatatattactgtgcggggggttcggggatttctacccctatggacgtctggggccaagggaccacggtcaccgtctcgagcggtacgggcggttcaggcggaaccggcagcggcactggcgggtcgacggacatccagatgacccagtctccagactccctggctgtgtctctgggcgagagggccaccatcaactgcaagtccggccagagtattttatacagctccaacgataagaactacttagcttggtaccagcagaaaccaggacagcctcctaagcttctcatttactgggcatctacccgggaatccggggtccctgaccgattcagtggcagcgggtctgggacagatttcactctcaccatcagcagcctgcaggctgaagatgtggcagtttattactgtcagcaatattatagtactccgtacacttttggccaggggaccaaggtggaaatcaaacgtgcggcc

SEQ ID NO: 274 - protein, 254 aa, Artificial sequence
  SC03-051
AMAQVQLVQSGTEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTVSSGTGGSGGTGSGTGGSTDIQMTQSPDSLAVSLGERATINCKSGQSILYSSNDKNYLAWYQQKPGQPPKLLIYWASTRESGVPDRFSGSGSGTDFTLTISSLQAEDVAVYYCQQYYSTPYTFGQGTKVEIKRAA

SEQ ID NO: 275 - DNA, 762 bp, Artificial sequence
  CDS (1)..(762): SC03-052
gccatggccgaagtgcagctggtgcagtctggaacagaggtgaaaaagccgggggagtctctgaaggtctcctgtaagggttctggatacggctttatcacctactggatcggctgggtgcgccagatgcccgggaaaggcctggagtggatggggatcatctatcctggtgactctgaaaccagatacagcccgtccttccaaggccaggtcaccatctcagccgacaagtccatcaacaccacctacctgcagtggagcagcctgaaggcctcggacaccgccatatattactgtgcggggggttcggggatttctacccctatggacgtctggggccaagggaccacggtcaccgtctcgagcggtacgggcggttcaggcggaaccggcagcggcactggcgggtcgacggacatccagatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactccgtacacttttggccaggggaccaaggtggaaatcaaacgtgcggcc

SEQ ID NO: 276 - protein, 254 aa, Artificial sequence
  SC03-052
AMAEVQLVQSGTEVKKPGESLKVSCKGSGYGFITYWIGWVRQMPGKGLEWMGIIYPGDSETRYSPSFQGQVTISADKSINTTYLQWSSLKASDTAIYYCAGGSGISTPMDVWGQGTTVTVSSGTGGSGGTGSGTGGSTDIQMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPYTFGQGTKVEIKRAA

SEQ ID NO: 277 - DNA, 768 bp, Artificial sequence
  CDS (1)..(768): SC03-053
gccatggcccaggtgcagctggtgcagtctggggctgaggtgaagaagcctggggcctcagtgatggtttcctgcaaggcctctggatacaccttcagtaactatgctatgcattgggtgcgccagggccccggacaaaggcttgagtggatgggatggatcaacgctgacaaaggtcagacaaaatattcacagaagttccagggcagagtcaccattaccggggacacatccgccagcacagcctacatggacctgagcagcctgagatctgaagacacggctgtgtattactgtgcgagagggaccggatatttgcggagctaccacggcatggacgtctggggccaggggaccacggtcaccgtctcgagcggtacgggcggttcaggcggaaccggcagcggcactggcgggtcgacggatgttgtgatgactcagtctccaccctccctgcccgtcacccctggggagccggcctccatctcctgcaggtctagtcagagcctcctccatagtaatggatacaactatttggattggtacctgcagaagccaggtcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcctctcaccttcggccaagggacacgactggagattaaacgtgcggcc

SEQ ID NO: 278 - protein, 256 aa, Artificial sequence
  SC03-053
AMAQVQLVQSGAEVKKPGASVMVSCKASGYTFSNYAMHWVRQGPGQRLEWMGWINADKGQTKYSQKFQGRVTITGDTSASTAYMDLSSLRSEDTAVYYCARGTGYLRSYHGMDVWGQGTTVTVSSGTGGSGGTGSGTGGSTDVVMTQSPPSLPVTPGEPASISCRSSQSLLHSNGYNYLDWYLQKPGQSPQLLIYLGSNRASGVPDRFSGSGSGTDFTLKISRVEAEDVGVYYCMQALQTPLTFGQGTRLEIKRAA

SEQ ID NO: 279 - DNA, 756 bp, Artificial sequence
  CDS (1)..(756): SC03-054
gccatggccgaagtgcagctggtgcagtctgggggaggcgtggtccagcctgggaggtccctgagactctcctgtgcagcctctggattcaccttcagtagttatgctatgcactgggtccgccaggctccagggaagggactggaatatgtttcaggtattagtagtaatgggggtagcacatattatgcaaactctgtgaagggcagattcaccatctccagagacaattccaagaacacgctgtatcttcaaatgggcagcctgagagctgaggacatggctgtgtattactgtgcgagaactactaatcgggcttttgatatctggggccaagggacaatggtcaccgtctcgagcggtacgggcggttcaggcggaaccggcagcggcactggcgggtcgacggacatccagttgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcggcgggtctgggacagatttcactctcaccatcagcagcctgcaggctgaagatgtggcagtttattactgtcagcaatattatagtactccgtacagttttggccaggggaccaaggtggagatcaaacgtgcggcc

SEQ ID NO: 280 - protein, 252 aa, Artificial sequence
  SC03-054
AMAEVQLVQSGGGVVQPGRSLRLSCAASGFTFSSYAMHWVRQAPGKGLEYVSGISSNGGSTYYANSVKGRFTISRDNSKNTLYLQMGSLRAEDMAVYYCARTTNRAFDIWGQGTMVTVSSGTGGSGGTGSGTGGSTDIQLTQSPDSLAVSLGERATINCKSSQSVLYSSNNKNYLAWYQQKPGQPPKLLIYWASTRESGVPDRFSGGGSGTDFTLTISSLQAEDVAVYYCQQYYSTPYSFGQGTKVEIKRAA

SEQ ID NO: 281 - DNA, 780 bp, Artificial sequence
  CDS (1)..(780): SC03-055
gccatggcccaggtgcagctacagcagtggggcgcaggactgttgaagccttcggagaccctgtccctcacctgcgctgtctatggtgggtccttcagtggtttctactggagctggatccgccagcccccagggaaggggctggagtggattggggaaatcaatcatagtggaagcaccaactacaacccgtccctcaagagtcgagtcaccatatcagcagacacgtccaagaaccagttctccctgaagctgagctctgtgaccgccgcggacacggctgtgtattactgtgcgagaagggtggaggtagtagagtaccagctgctccgtccccgatataaaagttggttcgacccctggggccagggaaccctggtcaccgtctcgagcggtacgggcggttcaggcggaaccggcagcggcactggcgggtcgacgcagtctgtgttgacgcagccgccctcagtgtctggggccccagggcagagggtctccatctcctgctctggaagcggcgccaatggtgggactgatcctgtttcttggtaccagaaattcccaggaacagccccccacctcctcatttatgacaataataagcgaccctcagggattcctgaccgattctctggctccaagtctggcgcgtcagccaccctggacatcaccggactccagactggggacgaggccgactattactgcggagcatgggatcccagtctgagcggttatgtcttcgggactgggacccagctcaccgttttaagtgcggcc

SEQ ID NO: 282 - protein, 260 aa, Artificial sequence
  SC03-055
AMAQVQLQQWGAGLLKPSETLSLTCAVYGGSFSGFYWSWIRQPPGKGLEWIGEINHSGSTNYNPSLKSRVTISADTSKNQFSLKLSSVTAADTAVYYCARRVEVVEYQLLRPRYKSWFDPWGQGTLVTVSSGTGGSGGTGSGTGGSTQSVLTQPPSVSGAPGQRVSISCSGSGANGGTDPVSWYQKFPGTAPHLLIYDNNKRPSGIPDRFSGSKSGASATLDITGLQTGDEADYYCGAWDPSLSGYVFGTGTQLTVLSAA

SEQ ID NO: 283 - DNA, 762 bp, Artificial sequence
  CDS (1)..(762): SC03-056
gccatggccgaagtgcagctggtgcagtctggaacagaggtgaaaaagccgggggagtctctgaagatctcctgtaagggttctggatacggctttatcacctactggatcggctgggtgcgccagatgcccgggaaaggcctggagtggatggggatcatctatcctggtgactctgaaaccagatacagcccgtccttccaaggccaggtcaccatctcagccgacaagtccatcaacaccgcctacctgcagtggagcagcctgaaggcctcggacaccgccatatattactgtgcggggggttcggggatttctacccctatggacgtctggggccaagggaccacggtcaccgtctcgagcggtacgggcggttcaggcggaaccggcagcggcactggcgggtcgacggatgttgtgatgactcagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactccgtacagttttggccaggggaccaaggtggagatcaaacgtgcggcc

SEQ ID NO: 284 - protein, 254 aa, Artificial sequence
  SC03-056
AMAEVQLVQSGTEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTVSSGTGGSGGTGSGTGGSTDVVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPYSFGQGTKVEIKRAA

SEQ ID NO: 285 - DNA, 768 bp, Artificial sequence
  CDS (1)..(768): SC03-057
gccatggcccaggtgcagctggtgcagtctggggctgaggtgaagaagcctgggtcctcggtgaaggtctcctgcaaggcttctggaggcaccttcagcagatatgctatcagttgggtgcgacaggcccctggacaaggccttgagtggatgggaaggatcaaccctatccttaatttaacaaactacgcacagaagttccagggcagagtcacgattaccgcggacaaatccacgagtacagcctacatggagatgagtagcctgagatctgaggacacggccatttattactgtgcgagcccggatatagtagtagccggtcacgcttcccccccacactacactatggacgtctggggccaagggaccacggtcaccgtctcgagcggtacgggcggttcaggcggaaccggcagcggcactggcgggtcgacggacatccagatgacccagtctccatcctcactgtctgcatctgtaggagacagagtcaccatcacttgccgggcaagtcagggcattagaaatgatttaggctggtatcagcagaaaccagggaaagcccctaacctcctgatctatcaggcatctgctttacagagtggggtcccatcaaggttcagcggcagtgaatctggggcagaattcactctcaccatcagcagcctgcaccctgatgattttgcaacttattactgccaacagtatcatgattttccgatcaccttcggccaagggacacgactggagattaaacgtgcggcc

SEQ ID NO: 286 - protein, 256 aa, Artificial sequence
  SC03-057
AMAQVQLVQSGAEVKKPGSSVKVSCKASGGTFSRYAISWVRQAPGQGLEWMGRINPILNLTNYAQKFQGRVTITADKSTSTAYMEMSSLRSEDTAIYYCASPDIVVAGHASPPHYTMDVWGQGTTVTVSSGTGGSGGTGSGTGGSTDIQMTQSPSSLSASVGDRVTITCRASQGIRNDLGWYQQKPGKAPNLLIYQASALQSGVPSRFSGSESGAEFTLTISSLHPDDFATYYCQQYHDFPITFGQGTRLEIKRAA

SEQ ID NO: 287 - DNA, 756 bp, Artificial sequence
  CDS (1)..(756): SC03-058
gccatggccgaggtccagctggtacagtctggaggaggcttggtccagcctggggggtccctcaaactctcctgtgcagcctctggattcaccttcagtagttatgctatgcactgggtccgccaggctccagggaagggactggaatatgtttcaggtattagtagtaatgggggtagcacatattatgcaaactctgtgaagggcagattcaccatctccagagacaattccaagaacacgctgtatcttcaaatgggcagcctgagagctgaggacatggctgtgtattactgtgcgagaactactaatcgggcttttgatatctggggccaagggacaatggtcaccgtctcgagcggtacgggcggttcaggcggaaccggcagcggcactggcgggtcgacggacatccagatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagattttactctcaccatcagcagtctgcaggctgaagatgtggcagtttattactgtcagcaatattatagtactcctctgacgttcggccaagggaccaaggtggaaatcaaacgtgcggcc

SEQ ID NO: 288 - protein, 252 aa, Artificial sequence
  SC03-058
AMAEVQLVQSGGGLVQPGGSLKLSCAASGFTFSSYAMHWVRQAPGKGLEYVSGISSNGGSTYYANSVKGRFTISRDNSKNTLYLQMGSLRAEDMAVYYCARTTNRAFDIWGQGTMVTVSSGTGGSGGTGSGTGGSTDIQMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPLTFGQGTKVEIKRAA

SEQ ID NO: 289 - DNA, 756 bp, Artificial sequence
  CDS (1)..(756): SC03-059
gccatggcccaggtgcagctggtgcaatctggggctgaggtgaagaagcctgggtcctcggtgaaggtctcctgcagggcttctggtggaggcgtcttccgcaattatgctatcaactgggtgcgacaggcccctggacaagggcttgagtggatgggaatgatcaaccctagtggtggtagcacaagctacgcacagaagttccagggcagagtcaccctgaccagggacacgtccacgagcacagtctacatggagctgagcagcctgagatctgaggacacggccgtgtattactgtgcgagattccctggtggtaccagaagccgcggctacatggacgtctggggcaaagggaccacggtcaccgtctcgagcggtacgggcggttcaggcggaaccggcagcggcactggcgggtcgacggaaattgtgctcacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctccggctttcggcggagggaccaaggtggagatcaaacgtgcggcc

SEQ ID NO: 290 - protein, 252 aa, Artificial sequence
  SC03-059
AMAQVQLVQSGAEVKKPGSSVKVSCRASGGGVFRNYAINWVRQAPGQGLEWMGMINPSGGSTSYAQKFQGRVTLTRDTSTSTVYMELSSLRSEDTAVYYCARFPGGTRSRGYMDVWGKGTTVTVSSGTGGSGGTGSGTGGSTEIVLTQSPATLSLSPGERATLSCRASQSVSSYLAWYQQKPGQAPRLLIYDASNRATGIPARFSGSGSGTDFTLTISSLEPEDFAVYYCQQRSNWPPAFGGGTKVEIKRAA

SEQ ID NO: 291 - protein, 13 aa, Artificial sequence
  HCDR3 of SC03-019 and SC03-059
FPGGTRSRGYMDV

SEQ ID NO: 292 - protein, 10 aa, Artificial sequence
  HCDR3 of SC03-020, SC03-021, SC03-022, SC03-033, SC03-034, SC03-0 35, SC03-036, SC03-051. SC03-052 and SC03-056
GSGISTPMDV

SEQ ID NO: 293 - protein, 20 aa, Artificial sequence
  HCDR3 of SC03-023 and SC03-055
RVEVVEYQLLRPRYKSWFDP

SEQ ID NO: 294 - protein, 10 aa, Artificial sequence
  HCDR3 of SC03-024
KSAGSNAFDI

SEQ ID NO: 295 - protein, 8 aa, Artificial sequence
  HCDR3 of SC03-025, SC03-026, SC03-027, SC03-029, SC03-030, SC03-0 40, SC03-050, SC03-054 and SC03-058
TTNRAFDI

SEQ ID NO: 296 - protein, 12 aa, Artificial sequence
  HCDR3 of SC03-031
ESGGGYDNHFDY

SEQ ID NO: 297 - protein, 16 aa, Artificial sequence
  HCDR3 of SC03-032
DGWDLTGSFLGYGMDV

SEQ ID NO: 298 - protein, 10 aa, Artificial sequence
  HCDR3 of SC03-037 and SC03-038
DAHRGFGMDV

SEQ ID NO: 299 - protein, 12 aa, Artificial sequence
  HCDR3 of SC03-039
GSKWNDVGGGDY

SEQ ID NO: 300 - protein, 13 aa, Artificial sequence
  HCDR3 of SC03-053
GTGYLRSYHGMDV

SEQ ID NO: 301 - protein, 17 aa, Artificial sequence
  HCDR3 of SC03-057
PDIVVAGHSPPHYTMDV

SEQ ID NO: 302 - DNA, 372 bp, Artificial sequence
  CDS (1)..(372): Variable heavy chain of SC03-019
atggcccagatgcagctggtgcagtctgggggaggcgtggtccagcctgggaggtccctgagactctcctgtgcagcctctggattcaccttcagtggctatgctatgcactgggtccgccaggctccaggcaaggggctggagtgggtggcagttatatcatatgatggaagcaataaatactacgcagactccgtgaagggccgattcgccatctccagagacaattccaagaacacgctgtatctgcaaatgaacagcctgagagctgaggacacggctgtgtattactgtgcgagattccctggtggtaccagaagccgcggctacatggacgtctggggcaaagggaccacggtcaccgtctcgagc

SEQ ID NO: 303 - protein, 124 aa, Artificial sequence
  Variable heavy chain of SC03-019
MAQMQLVQSGGGVVQPGRSLRLSCAASGFTFSGYAMHWVRQAPGKGLEWVAVISYDGSNKYYADSVKGRFAISRDNSKNTLYLQMNSLRAEDTAVYYCARFPGGTRSRGYMDVWGKGTTVTVSS

SEQ ID NO: 304 - DNA, 330 bp, Artificial sequence
  CDS (1)..(330): Variable light chain of SC03-019
gaaattgtgctcacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctccggctttcggcggagggaccaaggtggagatcaaacgtgcggcc

SEQ ID NO: 305 - protein, 110 aa, Artificial sequence
  Variable light chain of SC03-019
EIVLTQSPATLSLSPGERATLSCRASQSVSSYLAWYQQKPGQAPRLLIYDASNRATGIPARFSGSGSGTDFTLTISSLEPEDFAVYYCQQRSNWPPAFGGGTKVEIKRAA

SEQ ID NO: 306 - DNA, 363 bp, Artificial sequence
  CDS (1)..(363): Variable heavy chain of SC03-020
atggccgaagtgcagctggtgcagtctgggtcagaggtgaaaaagccgggggagtctctgaagatctcttgtaagggttctggatacggctttatcacctactggatcggctgggtgcgccagatgcccgggaaaggcctggagtggatggggatcatctatcctggtgactctgaaaccagatacagcccgtccttccaaggccaggtcaccatctcagccgacaagtccatcaacaccgcctacctgcagtggagcagcctgaaggcctcggacaccgccatatattactgtgcggggggttcggggatttctacccctatggacgtctggggccaagggaccacggtcaccgtctcgagc

SEQ ID NO: 307 - protein, 121 aa, Artificial sequence
  Variable heavy chain of SC03-020
MAEVQLVQSGSEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTVSS

SEQ ID NO: 308 - DNA, 348 bp, Artificial sequence
  CDS (1)..(348): Variable light chain of SC03-020
gacatccagatgacccagtctccagactccctggctgtgtctctgggcgagagggccaccatcaactgcaagtccagccagaaaattttacacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactcctccggttttcggcggagggaccaaggtggaaatcaaacgtgcggcc

SEQ ID NO: 309 - protein, 116 aa, Artificial sequence
  Variable light chain of SC03-020
DIQMTQSPDSLAVSLGERATINCKSSQKILHSSNNKNYLAWYQQKPGQPPKLLIYWASTRESGVPDRFSGSGSGTDFTLTISSLQAEDVAVYYCQQYYSTPPVFGGGTKVEIKRAA

SEQ ID NO: 310 - DNA, 363 bp, Artificial sequence
  CDS (1)..(363): Variable heavy chain of SC03-021
atggcccaggtccagctggtacagtctggaacagaggtgaaaaagccgggggagtctctgaagatctcctgtaagggttctggatacggctttatcacctactggatcggctgggtgcgccagatgcccgggaaaggcctggagtggatggggatcatctatcctggtgactctgaaaccagatacagcccgtccttccaaggccaggtcaccatctcagccgacaagtccatcaacaccgcctacctgcagtggagcagcctgaaggcctcggacaccgccatatattactgtgcggggggttcggggatttctacccctatggacgtctggggccaagggaccacggtcaccgtctcgagc

SEQ ID NO: 311 - protein, 121 aa, Artificial sequence
  Variable heavy chain of SC03-021
MAQVQLVQSGTEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTVSS

SEQ ID NO: 312 - DNA, 348 bp, Artificial sequence
  CDS (1)..(348): Variable light chain of SC03-021
gatgttgtgatgactcagtctccagactccctggctgtgtctctgggcgagagggccaccatcaactgcaagtccagccagagtgttttacacagctccaacaataagaactacctagcttggtaccagcagaaaccaggacagcctcctaagctgctcatttactgggcatctacccggcaatccggggtccctgaccgattcagtggcagcgggtctgggacagatttcactctcaccatcagcagcctgcaggctgaagatgtggcagtttattactgtcagcaatattatagtactcctccgacgttcggccaagggaccaaggtggaaatcaaacgtgcggcc

SEQ ID NO: 313 - protein, 116 aa, Artificial sequence
  Variable light chain of SC03-021
DVVMTQSPDSLAVSLGERATINCKSSQSVLHSSNNKNYLAWYQQKPGQPPKLLIYWASTRQSGVPDRFSGSGSGTDFTLTISSLQAEDVAVYYCQQYYSTPPTFGQGTKVEIKRAA

SEQ ID NO: 314 - DNA, 363 bp, Artificial sequence
  CDS (1)..(363): Variable heavy chain of SC03-022
atggcccagatgcagctggtgcaatctggaacagaggtgaaaaagccgggggagtctctgaagatctcctgtaagggttctggatacggctttatcacctactggatcggctgggtgcgccagatgcccgggaaaggcctggagtggatggggatcatctatcctggtgactctgaaaccagatacagcccgtccttccaaggccaggtcaccatctcagccgacaagtccatcaacaccgcctacctgcagtggagcagcctgaaggcctcggacaccgccatatattactgtgcggggggttcggggatttctacccctatggacgtctggggccaagggaccacggtcaccgtctcgagc

SEQ ID NO: 315 - protein, 121 aa, Artificial sequence
  Variable heavy chain of SC03-022
MAQMQLVQSGTEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTVSS

SEQ ID NO: 316 - DNA, 348 bp, Artificial sequence
  CDS (1)..(348): Variable light chain of SC03-022
gacatccagttgacccagtctccagactccctggctgtgtctctgggcgagagggccaccatcaactgcaagtccagccagagtgttttatacagctccatcaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactccgtacacttttggccaggggaccaaggtggaaatcaaacgtgcggcc

SEQ ID NO: 317 - protein, 116 aa, Artificial sequence
  Variable light chain of SC03-022
DIQLTQSPDSLAVSLGERATINCKSSQSVLYSSINKNYLAWYQQKPGQPPKLLIYWASTRESGVPDRFSGSGSGTDFTLTISSLQAEDVAVYYCQQYYSTPYTFGQGTKVEIKRAA

SEQ ID NO: 318 - DNA, 390 bp, Artificial sequence
  CDS (1)..(390): Variable heavy chain of SC03-023
atggcccaggtgcagctacagcagtggggcgcaggactgttgaagccttcggagaccctgtccctcacctgcgctgtctatggtgggtctttcagtggtttctactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagaagggtggaggtagtagagtaccagctgctccgtccccgatataaaagttggttcgacccctggggccagggcaccctggtcaccgtctcgagc

SEQ ID NO: 319 - protein, 130 aa, Artificial sequence
  Variable heavy chain of SC03-023
MAQVQLQQWGAGLLKPSETLSLTCAVYGGSFSGFYWSWIRQPPGKGLEWIGEINHSGSTNYNPSLKSRVTISVDTSKNQFSLKLSSVTAADTAVYYCARRVEVVEYQLLRPRYKSWFDPWGQGTLVTVSS

SEQ ID NO: 320 - DNA, 339 bp, Artificial sequence
  CDS (1)..(339): Variable light chain of SC03-023
cagtctgccctgactcagcctcgctcagtgtccgggtctcctggacagtcagtcaccatctcctgcactggatccagcagtactgttggtggttataactatgtctcctggtaccaacagcacccaggcaaagcccccaaactcatgatttatgatgtcagtaagcggccctcaggggtttctaatcgcttctctggctccaagtctggcaacacggcctccctgaccatctctgggctccaggctgaggacgaggctgattattactgcagctcatatacaagcagcagcacttatgtcttcggaactgggaccaaggtcaccgtcctaggtgcggcc

SEQ ID NO: 321 - protein, 113 aa, Artificial sequence
  Variable light chain of SC03-023
QSALTQPRSVSGSPGQSVTISCTGSSSTVGGYNYVSWYQQHPGKAPKLMIYDVSKRPSGVSNRFSGSKSGNTASLTISGLQAEDEADYYCSSYTSSSTYVFGTGTKVTVLGAA

SEQ ID NO: 322 - DNA, 363 bp, Artificial sequence
  CDS (1)..(363): Variable heavy chain of SC03-024
atggcccaggtgcagctggtggagtctgggtctgagttgaagatccctggggcctcagtgaaggtttcctgcaaggctactggatacaccttcactcgttattctctgaattgggtgcggcaggcccctggacaagggcttgagtgggtggggtggattaacacccagactggaaactcaaactatggccaggccttctcaggacggtttgtcttctccttggacacctcagtcagcacggcatatttgcaaatcagcagcctacaggccgaggacactgccacatactactgtgcgaggaagagtgcgggttcgaatgctttcgacatttggggccaagggacaatggtcaccgtctcgagc

SEQ ID NO: 323 - protein, 121 aa, Artificial sequence
  Variable heavy chain of SC03-024
MAQVQLVESGSELKIPGASVKVSCKATGYTFTRYSLNWVRQAPGQGLEWVGWINTQTGNSNYGQAFSGRFVFSLDTSVSTAYLQISSLQAEDTATYYCARKSAGSNAFDIWGQGTMVTVSS

SEQ ID NO: 324 - DNA, 339 bp, Artificial sequence
  CDS (1)..(339): Variable light chain of SC03-024
cagtctgtcgtgacgcagccgccctcagtgtctgcggccccaggacagaaggccaccatctcctgctctggaagcagctccaacattgggaataattatgtatcctggtaccagcagctcccaggaacagcccccaaactcctcatttatgacaataataagcgaccctcagggattcctaaccgattctctggctccaagtctggcacgtcagccaccctgggcatcaccggactccagactggggacgaggccgattattactgcggaacatgggatagcagcctgagtgcttatgtcttcggaactgggaccaaggtcaccgtcctaggtgcggcc

SEQ ID NO: 325 - protein, 113 aa, Artificial sequence
  Variable light chain of SC03-024
QSVVTQPPSVSAAPGQKATISCSGSSSNIGNNYVSWYQQLPGTAPKLLIYDNNKRPSGIPNRFSGSKSGTSATLGITGLQTGDEADYYCGTWDSSLSAYVFGTGTKVTVLGAA

SEQ ID NO: 326 - DNA, 357 bp, Artificial sequence
  CDS (1)..(357): Variable heavy chain of SC03-025
atggccgaggtgcagctggtggagtctgggggaggcttggtccagcctggggggtccctgagactctcctgtgcagcctctggattcaccttcagtagttatgctatgcactgggtccgccaggctccagggaagggactggaatatgtttcaggtattagtagtaatgggggtagcacatattatgcaaactctgtgaagggcagattcaccatctccagagacaattccaagaacacgctgtatcttcaaatgggcagcctgagagctgaggacatggctgtgtattactgtgcgagaactactaatcgggcttttgatatctggggccaagggacaatggtcaccgtctcgagc

SEQ ID NO: 327 - protein, 119 aa, Artificial sequence
  Variable heavy chain of SC03-025
MAEVQLVESGGGLVQPGGSLRLSCAASGFTFSSYAMHWVRQAPGKGLEYVSGISSNGGSTYYANSVKGRFTISRDNSKNTLYLQMGSLRAEDMAVYYCARTTNRAFDIWGQGTMVTVSS

SEQ ID NO: 328 - DNA, 348 bp, Artificial sequence
  CDS (1)..(348): Variable light chain of SC03-025
gacatccagttgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattataatattccgtatgctttcggccaggggaccaagctggagatcaaacgtgcggcc

SEQ ID NO: 329 - protein, 116 aa, Artificial sequence
  Variable light chain of SC03-025
DIQLTQSPDSLAVSLGERATINCKSSQSVLYSSNNKNYLAWYQQKPGQPPKLLIYWASIRESGVPDRFSGSGSGTDFTLTISSLQAEDVAVYYCQQYYNIPYAFGQGTKLEIKRAA

SEQ ID NO: 330 - DNA, 357 bp, Artificial sequence
  CDS (1)..(357): Variable heavy chain of SC03-026
atggcccaggtccagctggtacagtctgggggaggcttggtccagcctggggggtccctgagactctcctgtgcagcctctggattcaccttcagtagttatgccatgcactgggtccgccaggctccagggaagggactggaatatgtttcaggtattagtagtaatgggggtagcacatattatgcaaactctgtgaagggcagattcaccatctccagagacaattccaagaacacgctgtatcttcaaatgggcagcctgagagctgaggacatggctgtgtattactgtgcgagaactactaatcgggcttttgatatctggggccaagggacaatggtcaccgtctcgagc

SEQ ID NO: 331 - protein, 119 aa, Artificial sequence
  Variable heavy chain of SC03-026
MAQVQLVQSGGGLVQPGGSLRLSCAASGFTFSSYAMHWVRQAPGKGLEYVSGISSNGGSTYYANSVKGRFTISRDNSKNTLYLQMGSLRAEDMAVYYCARTTNRAFDIWGQGTMVTVSS

SEQ ID NO: 332 - DNA, 348 bp, Artificial sequence
  CDS (1)..(348): Variable light chain of SC03-026
gacatccagatgacccagtctccagactccctggctgtgtctctgggcgagagggccaccatcaactgcaagtccagccagagtattttatacagctccaacagtaagaactacttaggttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactccgtacagttttggccaggggaccaaggtggagatcaaacgtgcggcc

SEQ ID NO: 333 - protein, 116 aa, Artificial sequence
  Variable light chain of SC03-026
DIQMTQSPDSLAVSLGERATINCKSSQSILYSSNSKNYLGWYQQKPGQPPKLLIYWASTRESGVPDRFSGSGSGTDFTLTISSLQAEDVAVYYCQQYYSTPYSFGQGTKVEIKRAA

SEQ ID NO: 334 - DNA, 357 bp, Artificial sequence
  CDS (1)..(357): Variable heavy chain of SC03-027
atggcccaggtccagctggtgcagtctgggggaggcttggtccagcctggggggtccctgagactctcctgtgcagcctctggattcaccttcagtagttatgctatgcactgggtccgccaggctccagggaagggactggaatatgtttcaggtattagtagtaatgggggtagcacatattatgcaaactctgtgaagggcagattcaccatctccagagacaattccaagaacacgctgtatcttcaaatgggcagcctgagagctgaggacatggctgtgtattactgtgcgagaactactaatcgggcttttgatatctggggccaagggacaatggtcaccgtctcgagc

SEQ ID NO: 335 - protein, 119 aa, Artificial sequence; identical to SEQ ID NO: 331
  Variable heavy chain of SC03-027

SEQ ID NO: 336 - DNA, 348 bp, Artificial sequence
  CDS (1)..(348): Variable light chain of SC03-027
gacatccagatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactccgtacagttttggccaggggaccaaagtggatatcaaacgtgcggcc

SEQ ID NO: 337 - protein, 116 aa, Artificial sequence
  Variable light chain of SC03-027
DIQMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPYSFGQGTKVDIKRAA

SEQ ID NO: 338 - DNA, 357 bp, Artificial sequence
  CDS (1)..(357): Variable heavy chain of SC03-029
atggccgaagtgcagctggtgcagtctgggggaggcttggttcagccgggggggtccctgagactctcctgtgcagcctctggattcaccttcagtagttatgctatgcactgggtccgccaggctccagggaagggactggaatatgtttcaggtattagtagtaatgggggtagcacatattatgcaaactctgtgaagggcagattcaccatctccagagacaattccaagaacacgctgtatcttcaaatgggcagcctgagagctgaggacatggctgtgtattactgtgcgagaactactaatcgggcttttgatatctggggccaagggacaatggtcaccgtctcgagc

SEQ ID NO: 339 - protein, 119 aa, Artificial sequence
  Variable heavy chain of SC03-029
MAEVQLVQSGGGLVQPGGSLRLSCAASGFTFSSYAMHWVRQAPGKGLEYVSGISSNGGSTYYANSVKGRFTISRDNSKNTLYLQMGSLRAEDMAVYYCARTTNRAFDIWGQGTMVTVSS

SEQ ID NO: 340 - DNA, 348 bp, Artificial sequence
  CDS (1)..(348): Variable light chain of SC03-029
gacatccagatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactcctctcactttcggcgcagggaccaagctggagatcaaacgtgcggcc

SEQ ID NO: 341 - protein, 116 aa, Artificial sequence
  Variable light chain of SC03-029
DIQMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPLTFGAGTKLEIKRAA

SEQ ID NO: 342 - DNA, 357 bp, Artificial sequence
  CDS (1)..(357): Variable heavy chain of SC03-030
atggcggaggtccaggtggtacagtctggaggaggcttggtccagcctggggggtccctcaaactctcctgtgcagcctctggattcaccttcagtagttatgctatgcactgggtccgccaggctccagggaagggactggaatatgtttcaggtattagtagtaatgggggtagcacatattatgcaaactctgtgaagggcagattcaccatctccagagacaattccaagaacacgctgtatcttcaaatgggcagcctgagagctgaggacatggctgtgtattactgtgcgagaactactaatcgggcttttgatatctggggccaagggacaatggtcaccgtctcgagc

SEQ ID NO: 343 - protein, 119 aa, Artificial sequence
  Variable heavy chain of SC03-030
MAEVQVVQSGGGLVQPGGSLKLSCAASGFTFSSYAMHWVRQAPGKGLEYVSGISSNGGSTYYANSVKGRFTISRDNSKNTLYLQMGSLRAEDMAVYYCARTTNRAFDIWGQGTMVTVSS

SEQ ID NO: 344 - DNA, 348 bp, Artificial sequence
  CDS (1)..(348): Variable light chain of SC03-030
gacatccagatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagattttactctcaccatcagcagtctgcaggctgaagatgtggcagtttattactgtcagcaatattatagtactcctctgacgttcggccaagggaccaaggtggaaatcaaacgtgcggcc

SEQ ID NO: 345 - protein, 116 aa, Artificial sequence
  Variable light chain of SC03-030
DIQMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPLTFGQGTKVEIKRAA

SEQ ID NO: 346 - DNA, 369 bp, Artificial sequence
  CDS (1)..(369): Variable heavy chain of SC03-031
atggcccaggtgcagctggtgcaatctggggctgacgtgaagaagcctgggtcctcggtgaaggtctcctgcgaggcttctggaggcacgttcagcagctatgctatcagctgggtgcgacaggcccctggacaagggcttgagtggatgggaaggatcatccctatccttggtataacaaactacgcacagaagttccagggcagagtcacaattaccgcggacaaatccacgggcacaggcaacatggagctgagcagcctgagatctgaggacacggccgtgtattactgtgcgagagaatcgggtggtggctacgataaccactttgactactggggccagggaaccctggtcaccgtctcgagc

SEQ ID NO: 347 - protein, 123 aa, Artificial sequence
  Variable heavy chain of SC03-031
MAQVQLVQSGADVKKPGSSVKVSCEASGGTFSSYAISWVRQAPGQGLEWMGRIIPILGITNYAQKFQGRVTITADKSTGTGNMELSSLRSEDTAVYYCARESGGGYDNHFDYWGQGTLVTVSS

SEQ ID NO: 348 - DNA, 339 bp, Artificial sequence
  CDS (1)..(339): Variable light chain of SC03-031
cagtctgtgctgacgcagccgccctcagcgtctgggacccccggacagagggtcaccatctcttgttctggaggcagctccaacatcggaagtaatactgtaaactggtaccagcaactcccaggaacggcccccaaactcgtcatctatgctaataatcagcggccctcaggggtccctgaccgattctctgcctccaagtctggcacctcagcctccctggccatcagtgggctccagtctgaggatgaggctgattattactgtgcagcttgggatgacagcctgactggtggagtgttcggcggagggacccagctcaccgttttaagtgcggcc

SEQ ID NO: 349 - protein, 113 aa, Artificial sequence
  Variable light chain of SC03-031
QSVLTQPPSASGTPGQRVTISCSGGSSNIGSNTVNWYQQLPGTAPKLVIYANNQRPSGVPDRFSASKSGTSASLAISGLQSEDEADYYCAAWDDSLTGGVFGGGTQLTVLSAA

SEQ ID NO: 350 - DNA, 381 bp, Artificial sequence
  CDS (1)..(381): Variable heavy chain of SC03-032
atggccgaggtgcagctggtggagtctggggctgaggtgaagaagcctgggtcctcggtgaaggtctcctgcaaggcttctggaggcaccttcagcagctatgctatcagctgggtgcgacaggcccctggacaagggcttgagtggatgggaaagatcatccctattcttggtaaagtcacttacgcacagaagttccaggccagagtcacgattaccgcggacgaatccacgagcacagcctacctggagctgagcagcctgagatctgaggacacggccgttttttactgtgcgagagacggctgggatttgactggttcttttttaggctacggtatggacgtctggggccaagggaccacggtcaccgtctcgagc

SEQ ID NO: 351 - protein, 127 aa, Artificial sequence
  Variable heavy chain of SC03-032
MAEVQLVESGAEVKKPGSSVKVSCKASGGTFSSYAISWVRQAPGQGLEWMGKIIPILGKVTYAQKFQARVTITADESTSTAYLELSSLRSEDTAVFYCARDGWDLTGSFLGYGMDVWGQGTTVTVSS

SEQ ID NO: 352 - DNA, 339 bp, Artificial sequence
  CDS (1)..(339): Variable light chain of SC03-032
cagtctgtcgtgacgcagccgccctcagcgtctgggacccccgggcagagggtcaccatctcttgttctggaagcagctccaacatcggaagtaatactgtaagctggtaccagcaggttccagggacggcccccaagctcctcatctataggaataatcagcggcccccaggggtccytgaccgattctctggctccaagtctggcacctcagcctccytggccatcagtgggctccagtctgacgatgaggccttttattactgtgcagcatgggatggcagcmtgaatggtctggccttcggcggagggaccaagctgaccgtcctaggtgcggcc

SEQ ID NO: 353 - protein, 113 aa, Artificial sequence
  misc_feature (60)..(60): The 'Xaa' at location 60 stands for Pro, or Leu.
  misc_feature (74)..(74): The 'Xaa' at location 74 stands for Leu.
  misc_feature (96)..(96): The 'Xaa' at location 96 stands for Met, or Leu.
  Variable light chain of SC03-032
QSVVTQPPSASGTPGQRVTISCSGSSSNIGSNTVSWYQQVPGTAPKLLIYRNNQRPPGVXDRFSGSKSGTSASXAISGLQSDDEAFYYCAAWDGSXNGLAFGGGTKLTVLGAA

SEQ ID NO: 354 - DNA, 363 bp, Artificial sequence; identical to SEQ ID NO: 310
  CDS (1)..(363): Variable heavy chain of SC03-033

SEQ ID NO: 355 - protein, 121 aa, Artificial sequence; identical to SEQ ID NO: 311
  Variable heavy chain of SC03-033

SEQ ID NO: 356 - DNA, 351 bp, Artificial sequence
  CDS (1)..(351): Variable light chain of SC03-033
gatgttgtgatgactcagtctccagactccctggctgtgtctctgggcgagagggccaccatcaactgcaagaccagccacaatattttctccagatccaacaataaggactacttagcttggtaccagcagaaaccaggccagcctcccagattactcatttactgggcgtctacccgggcatccggggtccctgaacgattcagtggcagcggctctgggacagacttcagtctcaccatcagcagcctgcaggctgaagatgtggcggtttattactgtcagcaatattatagttcccctatgtacagttttggccaggggaccaaggtggagatcaaacgtgcggcc

SEQ ID NO: 357 - protein, 117 aa, Artificial sequence
  Variable light chain of SC03-033
DVVMTQSPDSLAVSLGERATINCKTSHNIFSRSNNKDYLAWYQQKPGQPPRLLIYWASTRASGVPERFSGSGSGTDFSLTISSLQAEDVAVYYCQQYYSSPMYSFGQGTKVEIKRAA

SEQ ID NO: 358 - DNA, 363 bp, Artificial sequence
  CDS (1)..(363): Variable heavy chain of SC03-034
atggccgaggtgcagctggtgcagtctggagcagaggtgaaaaagccgggggagtctctgaagatctcctgtaagggttctggatacggctttatcacctactggatcggctgggtgcgccagatgcccgggaaaggcctggagtggatggggatcatctatcctggtgactctgaaaccagatacagcccgtccttccaaggccaggtcaccatctcagccgacaagtccatcaacaccgcctacctgcagtggagcagcctgaaggcctcggacaccgccatatattactgtgcggggggttcggggatttctacccctatggacgtctggggccaagggaccacggtcaccgtctcgagc

SEQ ID NO: 359 - protein, 121 aa, Artificial sequence
  Variable heavy chain of SC03-034
MAEVQLVQSGAEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTVSS

SEQ ID NO: 360 - DNA, 348 bp, Artificial sequence
  CDS (1)..(348): Variable light chain of SC03-034
gatgttgtgatgactcagtctccagactccctggctgtgtctctgggcgagagggccaccatcaactgcaagtccagccagagtattttaaacagatccaacaataagaactacttagcttggtaccagcagaaaccaggacagcctcctaagctgctcatttactgggcatctacccgggaatccggggtccctgaccgattcagtggcagcgggtctgggacagatttcaatctcaccatcagcagcctgcaggctgaggatgtggcagtttattactgtcagcagtataataactggcctctcactttcggcggagggaccaaagtggatatcaaacgtgcggcc

SEQ ID NO: 361 - protein, 116 aa, Artificial sequence
  Variable light chain of SC03-034
DVVMTQSPDSLAVSLGERATINCKSSQSILNRSNNKNYLAWYQQKPGQPPKLLIYWASTRESGVPDRFSGSGSGTDFNLTISSLQAEDVAVYYCQQYNNWPLTFGGGTKVDIKRAA

SEQ ID NO: 362 - DNA, 363 bp, Artificial sequence
  CDS (1)..(363): Variable heavy chain of SC03-035
atggccgaggtgcagctggtgcagtctggagcagaggtgaaaaagcccggggagtctctgaagatctcctgtaagggttctggatacggctttatcacctactggatcggctgggtgcgccagatgcccgggaaaggcctggagtggatggggatcatctatcctggtgactctgaaaccagatacagcccgtccttccaaggccaggtcaccatctcagccgacaagtccatcaacaccgcctacctgcagtggagcagcctgaaggcctcggacaccgccatatattactgtgcggggggttcggggatttctacccctatggacgtctggggccaagggaccacggtcaccgtctcgagc

SEQ ID NO: 363 - protein, 121 aa, Artificial sequence; identical to SEQ ID NO: 359
  Variable heavy chain of SC03-035

SEQ ID NO: 364 - DNA, 351 bp, Artificial sequence
  CDS (1)..(351): Variable light chain of SC03-035
gacatccagatgacccagtctccagactccctggctgtgtctctgggcgagagggccaccatcaactgcaagtccagtcagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactcccctgtacagttttggccaggggaccaaggtggagatcaaacctgcggcc

SEQ ID NO: 365 - protein, 117 aa, Artificial sequence
  Variable light chain of SC03-035
DIQMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPLYSFGQGTKVEIKPAA

SEQ ID NO: 366 - DNA, 363 bp, Artificial sequence
  CDS (1)..(363): Variable heavy chain of SC03-036
atggccgaggtgcagctggtgcagtctggaacagaggtgaaaaagccgggggagtctctgaagatctcctgtaagggttctggatacggctttatcacctactggatcggctgggtgcgccagatgcccgggaaaggcctggagtggatggggatcatctatcctggtgactctgaaaccagatacagcccgtccttccaaggccaggtcaccatctcagccgacaagtccatcaacaccgcctacctgcagtggagcagcctgaaggcctcggacaccgccatatattactgtgcggggggttcggggatttctacccctatggacgtctggggccaagggaccacggtcaccgtctcgagc

SEQ ID NO: 367 - protein, 121 aa, Artificial sequence
  Variable heavy chain of SC03-036
MAEVQLVQSGTEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTVSS

SEQ ID NO: 368 - DNA, 345 bp, Artificial sequence
  CDS (1)..(345): Variable light chain of SC03-036
gacatccagatgacccagtctccagactccctggctgtgtctctgggcgagagggccaccatcaactgcaagtccagccagagtgttttacacagccccaacaataagaactacttggcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactaacagttttggccaggggaccaagctggagatcaaacgtgcggcc

SEQ ID NO: 369 - protein, 115 aa, Artificial sequence
  Variable light chain of SC03-036
DIQMTQSPDSLAVSLGERATINCKSSQSVLHSPNNKNYLAWYQQKPGQPPKLLIYWASTRESGVPDRFSGSGSGTDFTLTISSLQAEDVAVYYCQQYYSTNSFGQGTKLEIKRAA

SEQ ID NO: 370 - DNA, 360 bp, Artificial sequence
  CDS (1)..(360): Variable heavy chain of SC03-037
atggccaaagtgcagctggtgcagtctggaggaggcttgatccagcctggggggtccctgagactctcctgtgcagcctctggattcaccgtcagtagcaactacatgagctgggtccgccaggctccagggaaggggctggagtgggtctcaattgtttttagcggtggtagcacatactacgcagactccgtgaagggccgattcaccatctccagagacaattccaagaacacgctgtatcttcaaatgaacagcctgagagccgaggacacggccgtatattattgtgcgagagatgcccaccgggggttcggtatggacgtctggggccaagggaccacggtcaccgtctcgagc

SEQ ID NO: 371 - protein, 120 aa, Artificial sequence
  Variable heavy chain of SC03-037
MAKVQLVQSGGGLIQPGGSLRLSCAASGFTVSSNYMSWVRQAPGKGLEWVSIVFSGGSTYYADSVKGRFTISRDNSKNTLYLQMNSLRAEDTAVYYCARDAHRGFGMDVWGQGTTVTVSS

SEQ ID NO: 372 - DNA, 333 bp, Artificial sequence
  CDS (1)..(333): Variable light chain of SC03-037
tcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggcaaaaacaaccggccctcagggatcccagaccggttctctggctccagctcaggaaacacagcttccttgaccatcactggggctcaggcggaagatgaggccgactattattgtaacggccgggacagcagtggtaaccattgggtgttcggcggagggaccaagctgaccgtcctaggtgcggcc

SEQ ID NO: 373 - protein, 111 aa, Artificial sequence
  Variable light chain of SC03-037
SSELTQDPAVSVALGQTVRITCQGDSLRSYYASWYQQKPGQAPVLVIYGKNNRPSGIPDRFSGSSSGNTASLTITGAQAEDEADYYCNGRDSSGNHWVFGGGTKLTVLGAA

SEQ ID NO: 374 - DNA, 360 bp, Artificial sequence
  CDS (1)..(360): Variable heavy chain of SC03-038
atggccgaggtgcagctggtgcagtctggaggaggcttgatccagcctggggggtccctgagactctcctgtgcagcctctgggttcaccgtcagtagcaactacatgagctgggtccgccaggctccagggaaggggctggagtgggtctcaattgtttttagcggtggtagcacatactacgcagactccgtgaagggccgattcaccatctccagagacaattccaagaacacgctgtatcttcaaatgaacagcctgagagccgaggacacggccgtatattattgtgcgagagatgcccatcgggggttcggtatggacgtctggggccaggggaccacggtcaccgtctcgagc

SEQ ID NO: 375 - protein, 120 aa, Artificial sequence
  Variable heavy chain of SC03-038
MAEVQLVQSGGGLIQPGGSLRLSCAASGFTVSSNYMSWVRQAPGKGLEWVSIVFSGGSTYYADSVKGRFTISRDNSKNTLYLQMNSLRAEDTAVYYCARDAHRGFGMDVWGQGTTVTVSS

SEQ ID NO: 376 - DNA, 333 bp, Artificial sequence
  CDS (1)..(333): Variable light chain of SC03-038
tcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggagacacagcttccttgaccatcactggggctcaggcggaagatgaggctgactattactgtaactcccgggacagcagtggtaaccattgggtgttcggcggagggaccaagctgaccgtcctaggtgcggcc

SEQ ID NO: 377 - protein, 111 aa, Artificial sequence
  Variable light chain of SC03-038
SSELTQDPAVSVALGQTVRITCQGDSLRSYYASWYQQKPGQAPVLVIYGKNNRPSGIPDRFSGSSSGDTASLTITGAQAEDEADYYCNSRDSSGNHWVFGGGTKLTVLGAA

SEQ ID NO: 378 - DNA, 369 bp, Artificial sequence
  CDS (1)..(369): Variable heavy chain of SC03-039
atggccgaggtgcagctggtggagtctgggggaggcttggtacagcctggggggtccctgagactctcctgtgcagcctctggattcacctttagcagctatgccatgagctgggtccgccaggctccagggaaggggctggagtgggtctcagttatttatagcggtggtactagtacatactatgcagactccgtgaagggccggttcaccatctccagagataattccaagaacacactgtatctgcaaatgaacagcctgagagccgaggacacggccgtatatttctgtgcgaaaggatctaaatggaacgacgtgggggggggtgactactggggccagggaaccctggtcaccgtctcgagc

SEQ ID NO: 379 - protein, 123 aa, Artificial sequence
  Variable heavy chain of SC03-039
MAEVQLVESGGGLVQPGGSLRLSCAASGFTFSSYAMSWVRQAPGKGLEWVSVIYSGGTSTYYADSVKGRFTISRDNSKNTLYLQMNSLRAEDTAVYFCAKGSKWNDVGGGDYWGQGTLVTVSS

SEQ ID NO: 380 - DNA, 339 bp, Artificial sequence
  CDS (1)..(339): Variable light chain of SC03-039
aattttatgctgactcagccccactctgtgtcggagtctccggggaagacggtaaccatctcctgcgccggcagcagtggcagcattgccagcaactatgtgcagtggtaccagcaacgcccgggcagtgcccccactactgtgatctatgaggataaccaaagaccctctggggtccctgatcggttctctggctccatcgacagctcctccaactctgcctccctcaccatctctggactgaagactgaggacgaggctgactactactgtcagtcttatgatggttatctttggattttcggcggagggaccaagctgaccgtcctaggtgcggcc

SEQ ID NO: 381 - protein, 113 aa, Artificial sequence
  Variable light chain of SC03-039
NFMLTQPHSVSESPGKTVTISCAGSSGSIASNYVQWYQQRPGSAPTTVIYEDNQRPSGVPDRFSGSIDSSSNSASLTISGLKTEDEADYYCQSYDGYLWIFGGGTKLTVLGAA

SEQ ID NO: 382 - DNA, 357 bp, Artificial sequence
  CDS (1)..(357): Variable heavy chain of SC03-040
atggcccaggtccagctggtacagtctgggggaggcttggtccagcctggggggtccctgagactctcctgtgcagcctctggattcaccttcagtagttatgctatgcactgggtccgccaggctccagggaagggactggaatatgtttcaggtattagtagtaatgggggtagcacatattatgcaaactctgtgaagggcagattcaccatctccagagacaattccaagaacacgctgtatcttcaaatgggcagcctgagagctgaggacatggctgtgtattactgtgcgagaactactaatcgggcttttgatatctggggccaagggacaatggtcaccgtctcgagc

SEQ ID NO: 383 - protein, 119 aa, Artificial sequence; identical to SEQ ID NO: 331
  Variable heavy chain of SC03-040

SEQ ID NO: 384 - DNA, 348 bp, Artificial sequence
  CDS (1)..(348): Variable light chain of SC03-040
gacatccagatgacccagtctccagactccctggctgtgtctctgggcgagagggccaccatcaactgcaggtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtagtccgtacagttttggccaggggaccaagctggagatcaaacgtgcggcc

SEQ ID NO: 385 - protein, 116 aa, Artificial sequence
  Variable light chain of SC03-040
DIQMTQSPDSLAVSLGERATINCRSSQSVLYSSNNKNYLAWYQQKPGQPPKLLIYWASTRESGVPDRFSGSGSGTDFTLTISSLQAEDVAVYYCQQYYSSPYSFGQGTKLEIKRAA

SEQ ID NO: 386 - DNA, 357 bp, Artificial sequence; identical to SEQ ID NO: 334
  CDS (1)..(357): Variable heavy chain of SC03-041

SEQ ID NO: 387 - protein, 119 aa, Artificial sequence; identical to SEQ ID NO: 331
  Variable heavy chain of SC03-041

SEQ ID NO: 388 - DNA, 348 bp, Artificial sequence
  CDS (1)..(348): Variable light chain of SC03-041
gatatccagatgacccagtctccagactccctggctgtgtctctgggcgagcggaccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactccgtacagttttggccaggggaccaagctggagatcaaacgtgcggcc

SEQ ID NO: 389 - protein, 116 aa, Artificial sequence
  Variable light chain of SC03-041
DIQMTQSPDSLAVSLGERTTINCKSSQSVLYSSNNKNYLAWYQQKPGQPPKLLIYWASTRESGVPDRFSGSGSGTDFTLTISSLQAEDVAVYYCQQYYSTPYSFGQGTKLEIKRAA

SEQ ID NO: 390 - DNA, 357 bp, Artificial sequence
  misc_feature (150)..(151): n can be a, t, c, or g
  CDS (1)..(357): Variable heavy chain of SC03-042
atggcccagatgcagctggtgcaatctgggggaggcttagttcagcctggggggtccctgagactttcctgtgcagcctctggattcaccttcagtagttatgctatgcactgggtccgccaggctccagggaagggactggaatatgtntcaggtattagtagtaatgggggtagcacatattatgcaaactctgtgaagggcagattcaccatctccagagacaattccaagaacacgctgtatcttcaaatgggcagcctgagagctgaggacatggctgtgtattactgtgcgagaactactaatcgggcttttgatatctggggccaagggacaatggtcaccgtctcgagc

SEQ ID NO: 391 - protein, 119 aa, Artificial sequence
  Variable heavy chain of SC03-042
  misc_feature (150)..(151): n can be a, t, c, or g
MAQMQLVQSGGGLVQPGGSLRLSCAASGFTFSSYAMHWVRQAPGKGLEYVSGISSNGGSTYYANSVKGRFTISRDNSKNTLYLQMGSLRAEDMAVYYCARTTNRAFDIWGQGTMVTVSS

SEQ ID NO: 392 - DNA, 348 bp, Artificial sequence
  CDS (1)..(348): Variable light chain of SC03-042
gatgttgtgatgactcagtctccagactccctggctgtgtctctgggcgagagggccaccatcaactgcaagtccagccagagtgttttatacagctccaacgataagaactacttagcttggtaccagcagaaaccaggacagcctcctaagctgctcatttactgggcatctacccgggaatccggggtccctgaccgattcagcggcagcgggtctgggacagatttcactctcaccatcagcagcctgcaggctgaagatgtggcagtttattactgtcagcaatattatagtactccgtacagttttggccaggggaccaagctggagatcaaacgtgcggcc

SEQ ID NO: 393 - protein, 116 aa, Artificial sequence
  Variable light chain of SC03-042
DVVMTQSPDSLAVSLGERATINCKSSQSVLYSSNDKNYLAWYQQKPGQPPKLLIYWASTRESGVPDRFSGSGSGTDFTLTISSLQAEDVAVYYCQQYYSTPYSFGQGTKLEIKRAA

SEQ ID NO: 394 - DNA, 357 bp, Artificial sequence; identical to SEQ ID NO: 334
  CDS (1)..(357): Variable heavy chain of SC03-043

SEQ ID NO: 395 - protein, 119 aa, Artificial sequence; identical to SEQ ID NO: 331
  Variable heavy chain of SC03-043

SEQ ID NO: 396 - DNA, 348 bp, Artificial sequence
  CDS (1)..(348): Variable light chain of SC03-043
gacatccagttgacccagtctccagactccctggctgtgtctctgggcgagagggccaccatcaactgcaagtccagccagagtgttttatacaggtccaacaataagaactacttagcttggtaccagcagaagccaggacagcctcctaagctgctcatttactgggcatctacccgtgaatccggggtctctgagcgattcagtggcagcgggtctgggacagatttcactctcaccatcagcagcctgcaggctgaagatgtggcagtttattactgtcagcaatattatagtaccccgtacagttttggccaggggaccaagctggagatcaaacgtgcggcc

SEQ ID NO: 397 - protein, 116 aa, Artificial sequence
  Variable light chain of SC03-043
DIQLTQSPDSLAVSLGERATINCKSSQSVLYRSNNKNYLAWYQQKPGQPPKLLIYWASTRESGVSERFSGSGSGTDFTLTISSLQAEDVAVYYCQQYYSTPYSFGQGTKLEIKRAA

SEQ ID NO: 398 - DNA, 357 bp, Artificial sequence
  CDS (1)..(357): Variable heavy chain of SC03-044
atggccgaggtgcagctggtggagactgggggaggcttggtccagcctggggggtccctgagactctcctgtgcagcctctggattcaccttcagtagttatgctatgcactgggtccgccaggctccagggaagggactggaatatgtttcaggtattagtagtaatgggggtagcacatattatgcaaactctgtgaagggcagattcaccatctccagagacaattccaagaacacgctgtatcttcaaatgggcagcctgagagctgaggacatggctgtgtattactgtgcgagaactactaatcgggcttttgatatctggggccaagggacaatggtcaccgtctcgagc

SEQ ID NO: 399 - protein, 119 aa, Artificial sequence
  Variable heavy chain of SC03-044
MAEVQLVETGGGLVQPGGSLRLSCAASGFTFSSYAMHWVRQAPGKGLEYVSGISSNGGSTYYANSVKGRFTISRDNSKNTLYLQMGSLRAEDMAVYYCARTTNRAFDIWGQGTMVTVSS

SEQ ID NO: 400 - DNA, 348 bp, Artificial sequence
  CDS (1)..(348): Variable light chain of SC03-044
gacatccagatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcaggggcagcgggtccgggacagatttcactctcaccatcagcagcctgcaggctgaagatctggcagtttattactgtcagcaatattatagtactccgtacagttttggccaggggaccaagctggagatcaaacgtgcggcc

SEQ ID NO: 401 - protein, 116 aa, Artificial sequence
  Variable light chain of SC03-044
DIQMTQSPDSLAVSLGERATINCKSSQSVLYSSNNKNYLAWYQQKPGQPPKLLIYWASTRESGVPDRFRGSGSGTDFTLTISSLQAEDLAVYYCQQYYSTPYSFGQGTKLEIKRAA

SEQ ID NO: 402 - DNA, 357 bp, Artificial sequence
  CDS (1)..(357): Variable heavy chain of SC03-045
atggcccagctgcagctgcaggagtcggggggaggcttggtccagcctggggggtccctgagactctcctgtgcagcctctggattcaccttcagtagttatgctatgcactgggtccgccaggctccagggaagggactggaatatgtttcaggtattagtagtaatgggggtagtacatattatgcaaactctgtgaagggcagattcaccatctccagagacaattccaagaacacgctgtatcttcaaatgggcagcctgagagctgaggacatggctgtgtattactgtgcgagaactactaatcgggcttttgatatctggggccaggggacaatggtcaccgtctcgagc

SEQ ID NO: 403 - protein, 119 aa, Artificial sequence
  Variable heavy chain of SC03-045
MAQLQLQESGGGLVQPGGSLRLSCAASGFTFSSYAMHWVRQAPGKGLEYVSGISSNGGSTYYANSVKGRFTISRDNSKNTLYLQMGSLRAEDMAVYYCARTTNRAFDIWGQGTMVTVSS

SEQ ID NO: 404 - DNA, 348 bp, Artificial sequence
  CDS (1)..(348): Variable light chain of SC03-045
gacatccagctgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactccattcactttcggccctgggaccaaagtggatatcaaacgtgcggcc

SEQ ID NO: 405 - protein, 116 aa, Artificial sequence
  Variable light chain of SC03-045
DIQLTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPFTFGPGTKVDIKRAA

SEQ ID NO: 406 - DNA, 357 bp, Artificial sequence
  CDS (1)..(357): Variable heavy chain of SC03-046
atggccgaggtccagctggtacagtctgggggaggcttggtccagcctggggggtccctgagactctcctgtgcagcctctggattcaccttcagtagttatgctatgcactgggtccgccaggctccagggaagggactggaatatgtttcaggtattagtagtaatgggggtagcacatattatgcaaactctgtgaagggcagattcaccatctccagagacaattccaagaacacgctgtatcttcaaatgggcagcctgagagctgaggacatggctgtgtattactgtgcgagaactactaatcgggcttttgatatctggggccaagggacaatggtcaccgtctcgagc

SEQ ID NO: 407 - protein, 119 aa, Artificial sequence; identical to SEQ ID NO: 339
  Variable heavy chain of SC03-046

SEQ ID NO: 408 - DNA, 348 bp, Artificial sequence
  CDS (1)..(348): Variable light chain of SC03-046
gatgttgtgatgactcagtctccagactccctggctgtgtctctgggcgagagggccaccatcaactgcaagtccagccagagtgttttatacagctccaacaataagaactacttagcttggtaccagcagaaaccagggcagcctcctaagctgctcatttactgggcatctacccgggaatccggggtccctgacaggttcagtggcagcgggtctgggacagacttcagtctcaccatcagcagcctgcaggctgaagatgtggcggtttattactgtcagcaatattacagtcctccgtacacttttggcccggggaccaaggtggaaatcaaacgtgcggcc

SEQ ID NO: 409 - protein, 116 aa, Artificial sequence
  Variable light chain of SC03-046
DVVMTQSPDSLAVSLGERATINCKSSQSVLYSSNNKNYLAWYQQKPGQPPKLLIYWASTRESGVPDRFSGSGSGTDFSLTISSLQAEDVAVYYCQQYYSPPYTFGPGTKVEIKRAA

SEQ ID NO: 410 - DNA, 357 bp, Artificial sequence
  CDS (1)..(357): Variable heavy chain of SC03-047
atggccgaggtgcagctggtgcagtctgggggaggcttggtccagcctggggggtccctgagactctcctgtgcagcctctggattcaccttcagtagttatgctatgcactgggtccgccaggctccagggaagggactggaatatgtttcaggtattagtagtaatgggggtagcacatattatgcaaactctgtgaagggcagattcaccatctccagagacaattccaagaacacgctgtatcttcaaatgggcagcctgagagctgaggacatggctgtgtattactgtgcgagaactactaatcgggcttttgatatctggggccaggggacaatggtcaccgtctcgagc

SEQ ID NO: 411 - protein, 119 aa, Artificial sequence; identical to SEQ ID NO: 339
  Variable heavy chain of SC03-047

SEQ ID NO: 412 - DNA, 348 bp, Artificial sequence
  CDS (1)..(348): Variable light chain of SC03-047
gatgttgtgatgactcagtctccagactccctggctgtgtctctgggcgagagggccaccatcaactgcaagtccagccagagtgttttatatagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactcctctcactttcggcggagggaccaaggtggaaatcaaacgtgcggcc

SEQ ID NO: 413 - protein, 116 aa, Artificial sequence
  Variable light chain of SC03-047
DVVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPLTFGGGTKVEIKRAA

SEQ ID NO: 414 - DNA, 357 bp, Artificial sequence; identical to SEQ ID NO: 398
  CDS (1)..(357): Variable heavy chain of SC03-048

SEQ ID NO: 415 - protein, 119 aa, Artificial sequence; identical to SEQ ID NO: 399
  Variable heavy chain of SC03-048

SEQ ID NO: 416 - DNA, 348 bp, Artificial sequence
  CDS (1)..(348): Variable light chain of SC03-048
gacatccagttgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattacagtactccgctcactttcggcggagggaccaaggtggaaatcaaacgtgcggcc

SEQ ID NO: 417 - protein, 116 aa, Artificial sequence
  Variable light chain of SC03-048
DIQLTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPLTFGGGTKVEIKRAA

SEQ ID NO: 418 - DNA, 357 bp, Artificial sequence
  CDS (1)..(357): Variable heavy chain of SC03-049
atggcccaggtgcagctggtgcagtctgggggaggcttggtccagcctggggggtccctgagactctcctgtgcagcctctggattcaccttcagtagttatgctatgcactgggtccgccaggctccagggaagggactggaatatgtttcaggtattagtagtaatgggggtagcacatattatgcaaactctgtgaagggcagattcaccatctccagagacaattccaagaacacgctgtatcttcaaatgggcagcctgagagctgaggacatggctgtgtattactgtgcgagaactactaatcgggcttttgacatctggggccaagggacaatggtcaccgtctcgagc

SEQ ID NO: 419 - protein, 119 aa, Artificial sequence; identical to SEQ ID NO: 331
  Variable heavy chain of SC03-049

SEQ ID NO: 420 - DNA, 348 bp, Artificial sequence
  CDS (1)..(348): Variable light chain of SC03-049
gacatccagttgacccagtctccatcctccctggctgtgtctctgggcgagagggccaccatcaactgcaagtccagccagagtgttttatacagctccaacaataagaactacttagcttggtatcagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactccgctcactttcggcggagggaccaaggtggagatcaaacgtgcggcc

SEQ ID NO: 421 - protein, 116 aa, Artificial sequence
  Variable light chain of SC03-049
DIQLTQSPSSLAVSLGERATINCKSSQSVLYSSNNKNYLAWYQQKPGQPPKLLIYWASTRESGVPDRFSGSGSGTDFTLTISSLQAEDVAVYYCQQYYSTPLTFGGGTKVEIKRAA

SEQ ID NO: 422 - DNA, 357 bp, Artificial sequence
  CDS (1)..(357): Variable heavy chain of SC03-050
atggccgaagtgcagctggtgcagtctgggggaggcttggtccagcctggggggtccctgagactctcctgtgcagcctctggattcaccttcagtagttatgctatgcactgggtccgccaggctccagggaagggactggaatatgtttcaggtattagtagtaatgggggtagcacatattatgcaaactctgtgaagggcagattcaccatctccagagacaattccaagaacacgctgtatcttcaaatgggcagcctgagagctgaggacatggctgtgtattactgtgcgagaactactaatcgggcttttgatatctggggccaagggacaatggtcaccgtctcgagc

SEQ ID NO: 423 - protein, 119 aa, Artificial sequence; identical to SEQ ID NO: 339
  Variable heavy chain of SC03-050

SEQ ID NO: 424 - DNA, 348 bp, Artificial sequence
  CDS (1)..(348): Variable light chain of SC03-050
gacatccagatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactccgctcactttcggcggagggaccaaggtggaaatcaaacgtgcggcc

SEQ ID NO: 425 - protein, 116 aa, Artificial sequence
  Variable light chain of SC03-050
DIQMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPLTFGGGTKVEIKRAA

SEQ ID NO: 426 - DNA, 363 bp, Artificial sequence
  CDS (1)..(363): Variable heavy chain of SC03-051
atggcccaggtgcagctggtgcagtctggaacagaggtgaaaaagccgggggagtctctgaagatctcctgtaagggttctggatacggctttatcacctactggatcggctgggtgcgccagatgcccgggaaaggcctggagtggatggggatcatctatcctggtgactctgaaaccagatacagcccgtccttccaaggccaggtcaccatctcagccgacaagtccatcaacaccgcctacctgcagtggagcagcctgaaggcctcggacaccgccatatattactgtgcggggggttcggggatttctacccctatggacgtctggggccaagggaccacggtcaccgtctcgagc

SEQ ID NO: 427 - protein, 121 aa, Artificial sequence; identical to SEQ ID NO: 311
  Variable heavy chain of SC03-051

SEQ ID NO: 428 - DNA, 348 bp, Artificial sequence
  CDS (1)..(348): Variable light chain of SC03-051
gacatccagatgacccagtctccagactccctggctgtgtctctgggcgagagggccaccatcaactgcaagtccggccagagtattttatacagctccaacgataagaactacttagcttggtaccagcagaaaccaggacagcctcctaagcttctcatttactgggcatctacccgggaatccggggtccctgaccgattcagtggcagcgggtctgggacagatttcactctcaccatcagcagcctgcaggctgaagatgtggcagtttattactgtcagcaatattatagtactccgtacacttttggccaggggaccaaggtggaaatcaaacgtgcggcc

SEQ ID NO: 429 - protein, 116 aa, Artificial sequence
  Variable light chain of SC03-051
DIQMTQSPDSLAVSLGERATINCKSGQSILYSSNDKNYLAWYQQKPGQPPKLLIYWASTRESGVPDRFSGSGSGTDFTLTISSLQAEDVAVYYCQQYYSTPYTFGQGTKVEIKRAA

SEQ ID NO: 430 - DNA, 363 bp, Artificial sequence
  CDS (1)..(363): Variable heavy chain of SC03-052
atggccgaagtgcagctggtgcagtctggaacagaggtgaaaaagccgggggagtctctgaaggtctcctgtaagggttctggatacggctttatcacctactggatcggctgggtgcgccagatgcccgggaaaggcctggagtggatggggatcatctatcctggtgactctgaaaccagatacagcccgtccttccaaggccaggtcaccatctcagccgacaagtccatcaacaccacctacctgcagtggagcagcctgaaggcctcggacaccgccatatattactgtgcggggggttcggggatttctacccctatggacgtctggggccaagggaccacggtcaccgtctcgagc

SEQ ID NO: 431 - protein, 121 aa, Artificial sequence
  Variable heavy chain of SC03-052
MAEVQLVQSGTEVKKPGESLKVSCKGSGYGFITYWIGWVRQMPGKGLEWMGIIYPGDSETRYSPSFQGQVTISADKSINTTYLQWSSLKASDTAIYYCAGGSGISTPMDVWGQGTTVTVSS

SEQ ID NO: 432 - DNA, 348 bp, Artificial sequence
  CDS (1)..(348): Variable light chain of SC03-052
gacatccagatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactccgtacacttttggccaggggaccaaggtggaaatcaaacgtgcggcc

SEQ ID NO: 433 - protein, 116 aa, Artificial sequence
  Variable light chain of SC03-052
DIQMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPYTFGQGTKVEIKRAA

SEQ ID NO: 434 - DNA, 372 bp, Artificial sequence
  CDS (1)..(372): Variable heavy chain of SC03-053
atggcccaggtgcagctggtgcagtctggggctgaggtgaagaagcctggggcctcagtgatggtttcctgcaaggcctctggatacaccttcagtaactatgctatgcattgggtgcgccagggccccggacaaaggcttgagtggatgggatggatcaacgctgacaaaggtcagacaaaatattcacagaagttccagggcagagtcaccattaccggggacacatccgccagcacagcctacatggacctgagcagcctgagatctgaagacacggctgtgtattactgtgcgagagggaccggatatttgcggagctaccacggcatggacgtctggggccaggggaccacggtcaccgtctcgagc

SEQ ID NO: 435 - protein, 124 aa, Artificial sequence
  Variable heavy chain of SC03-053
MAQVQLVQSGAEVKKPGASVMVSCKASGYTFSNYAMHWVRQGPGQRLEWMGWINADKGQTKYSQKFQGRVTITGDTSASTAYMDLSSLRSEDTAVYYCARGTGYLRSYHGMDVWGQGTTVTVSS

SEQ ID NO: 436 - DNA, 345 bp, Artificial sequence
  CDS (1)..(345): Variable light chain of SC03-053
gatgttgtgatgactcagtctccaccctccctgcccgtcacccctggggagccggcctccatctcctgcaggtctagtcagagcctcctccatagtaatggatacaactatttggattggtacctgcagaagccaggtcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcctctcaccttcggccaagggacacgactggagattaaacgtgcggcc

SEQ ID NO: 437 - protein, 115 aa, Artificial sequence
  Variable light chain of SC03-053
DVVMTQSPPSLPVTPGEPASISCRSSQSLLHSNGYNYLDWYLQKPGQSPQLLIYLGSNRASGVPDRFSGSGSGTDFTLKISRVEAEDVGVYYCMQALQTPLTFGQGTRLEIKRAA

SEQ ID NO: 438 - DNA, 357 bp, Artificial sequence
  CDS (1)..(357): Variable heavy chain of SC03-054
atggccgaagtgcagctggtgcagtctgggggaggcgtggtccagcctgggaggtccctgagactctcctgtgcagcctctggattcaccttcagtagttatgctatgcactgggtccgccaggctccagggaagggactggaatatgtttcaggtattagtagtaatgggggtagcacatattatgcaaactctgtgaagggcagattcaccatctccagagacaattccaagaacacgctgtatcttcaaatgggcagcctgagagctgaggacatggctgtgtattactgtgcgagaactactaatcgggcttttgatatctggggccaagggacaatggtcaccgtctcgagc

SEQ ID NO: 439 - protein, 119 aa, Artificial sequence
  Variable heavy chain of SC03-054
MAEVQLVQSGGGVVQPGRSLRLSCAASGFTFSSYAMHWVRQAPGKGLEYVSGISSNGGSTYYANSVKGRFTISRDNSKNTLYLQMGSLRAEDMAVYYCARTTNRAFDIWGQGTMVTVSS

SEQ ID NO: 440 - DNA, 348 bp, Artificial sequence
  CDS (1)..(348): Variable light chain of SC03-054
gacatccagttgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcggcgggtctgggacagatttcactctcaccatcagcagcctgcaggctgaagatgtggcagtttattactgtcagcaatattatagtactccgtacagttttggccaggggaccaaggtggagatcaaacgtgcggcc

SEQ ID NO: 441 - protein, 116 aa, Artificial sequence
  Variable light chain of SC03-054
DIQLTQSPDSLAVSLGERATINCKSSQSVLYSSNNKNYLAWYQQKPGQPPKLLIYWASTRESGVPDRFSGGGSGTDFTLTISSLQAEDVAVYYCQQYYSTPYSFGQGTKVEIKRAA

SEQ ID NO: 442 - DNA, 390 bp, Artificial sequence
  CDS (1)..(390): Variable heavy chain of SC03-055
atggcccaggtgcagctacagcagtggggcgcaggactgttgaagccttcggagaccctgtccctcacctgcgctgtctatggtgggtccttcagtggtttctactggagctggatccgccagcccccagggaaggggctggagtggattggggaaatcaatcatagtggaagcaccaactacaacccgtccctcaagagtcgagtcaccatatcagcagacacgtccaagaaccagttctccctgaagctgagctctgtgaccgccgcggacacggctgtgtattactgtgcgagaagggtggaggtagtagagtaccagctgctccgtccccgatataaaagttggttcgacccctggggccagggaaccctggtcaccgtctcgagc

SEQ ID NO: 443 - protein, 130 aa, Artificial sequence
  Variable heavy chain of SC03-055
MAQVQLQQWGAGLLKPSETLSLTCAVYGGSFSGFYWSWIRQPPGKGLEWIGEINHSGSTNYNPSLKSRVTISADTSKNQFSLKLSSVTAADTAVYYCARRVEVVEYQLLRPRYKSWFDPWGQGTLVTVSS

SEQ ID NO: 444 - DNA, 339 bp, Artificial sequence
  CDS (1)..(339): Variable light chain of SC03-055
cagtctgtgttgacgcagccgccctcagtgtctggggccccagggcagagggtctccatctcctgctctggaagcggcgccaatggtgggactgatcctgtttcttggtaccagaaattcccaggaacagccccccacctcctcatttatgacaataataagcgaccctcagggattcctgaccgattctctggctccaagtctggcgcgtcagccaccctggacatcaccggactccagactggggacgaggccgactattactgcggagcatgggatcccagtctgagcggttatgtcttcgggactgggacccagctcaccgttttaagtgcggcc

SEQ ID NO: 445 - protein, 113 aa, Artificial sequence
  Variable light chain of SC03-055
QSVLTQPPSVSGAPGQRVSISCSGSGANGGTDPVSWYQKFPGTAPHLLIYDNNKRPSGIPDRFSGSKSGASATLDITGLQTGDEADYYCGAWDPSLSGYVFGTGTQLTVLSAA

SEQ ID NO: 446 - DNA, 363 bp, Artificial sequence
  CDS (1)..(363): Variable heavy chain of SC03-056
atggccgaagtgcagctggtgcagtctggaacagaggtgaaaaagccgggggagtctctgaagatctcctgtaagggttctggatacggctttatcacctactggatcggctgggtgcgccagatgcccgggaaaggcctggagtggatggggatcatctatcctggtgactctgaaaccagatacagcccgtccttccaaggccaggtcaccatctcagccgacaagtccatcaacaccgcctacctgcagtggagcagcctgaaggcctcggacaccgccatatattactgtgcggggggttcggggatttctacccctatggacgtctggggccaagggaccacggtcaccgtctcgagc

SEQ ID NO: 447 - protein, 121 aa, Artificial sequence; identical to SEQ ID NO: 367
  Variable heavy chain of SC03-056

SEQ ID NO: 448 - DNA, 348 bp, Artificial sequence
  CDS (1)..(348): Variable light chain of SC03-056
gatgttgtgatgactcagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactccgtacagttttggccaggggaccaaggtggagatcaaacgtgcggcc

SEQ ID NO: 449 - protein, 116 aa, Artificial sequence
  Variable light chain of SC03-056
DVVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPYSFGQGTKVEIKRAA

SEQ ID NO: 450 - DNA, 387 bp, Artificial sequence
  CDS (1)..(387): Variable heavy chain of SC03-057
atggcccaggtgcagctggtgcagtctggggctgaggtgaagaagcctgggtcctcggtgaaggtctcctgcaaggcttctggaggcaccttcagcagatatgctatcagttgggtgcgacaggcccctggacaaggccttgagtggatgggaaggatcaaccctatccttaatttaacaaactacgcacagaagttccagggcagagtcacgattaccgcggacaaatccacgagtacagcctacatggagatgagtagcctgagatctgaggacacggccatttattactgtgcgagcccggatatagtagtagccggtcacgcttcccccccacactacactatggacgtctggggccaagggaccacggtcaccgtctcgagc

SEQ ID NO: 451 - protein, 129 aa, Artificial sequence
  Variable heavy chain of SC03-057
MAQVQLVQSGAEVKKPGSSVKVSCKASGGTFSRYAISWVRQAPGQGLEWMGRINPILNLTNYAQKFQGRVTITADKSTSTAYMEMSSLRSEDTAIYYCASPDIVVAGHASPPHYTMDVWGQGTTVTVSS

SEQ ID NO: 452 - DNA, 330 bp, Artificial sequence
  CDS (1)..(330): Variable light chain of SC03-057
gacatccagatgacccagtctccatcctcactgtctgcatctgtaggagacagagtcaccatcacttgccgggcaagtcagggcattagaaatgatttaggctggtatcagcagaaaccagggaaagcccctaacctcctgatctatcaggcatctgctttacagagtggggtcccatcaaggttcagcggcagtgaatctggggcagaattcactctcaccatcagcagcctgcaccctgatgattttgcaacttattactgccaacagtatcatgattttccgatcaccttcggccaagggacacgactggagattaaacgtgcggcc

SEQ ID NO: 453 - protein, 110 aa, Artificial sequence
  Variable light chain of SC03-057
DIQMTQSPSSLSASVGDRVTITCRASQGIRNDLGWYQQKPGKAPNLLIYQASALQSGVPSRFSGSESGAEFTLTISSLHPDDFATYYCQQYHDFPITFGQGTRLEIKRAA

SEQ ID NO: 454 - DNA, 357 bp, Artificial sequence
  CDS (1)..(357): Variable heavy chain of SC03-058
atggccgaggtccagctggtacagtctggaggaggcttggtccagcctggggggtccctcaaactctcctgtgcagcctctggattcaccttcagtagttatgctatgcactgggtccgccaggctccagggaagggactggaatatgtttcaggtattagtagtaatgggggtagcacatattatgcaaactctgtgaagggcagattcaccatctccagagacaattccaagaacacgctgtatcttcaaatgggcagcctgagagctgaggacatggctgtgtattactgtgcgagaactactaatcgggcttttgatatctggggccaagggacaatggtcaccgtctcgagc

SEQ ID NO: 455 - protein, 119 aa, Artificial sequence
  Variable heavy chain of SC03-058
MAEVQLVQSGGGLVQPGGSLKLSCAASGFTFSSYAMHWVRQAPGKGLEYVSGISSNGGSTYYANSVKGRFTISRDNSKNTLYLQMGSLRAEDMAVYYCARTTNRAFDIWGQGTMVTVSS

SEQ ID NO: 456 - DNA, 348 bp, Artificial sequence; identical to SEQ ID NO: 344
  CDS (1)..(348): Variable heavy chain of SC03-058

SEQ ID NO: 457 - protein, 116 aa, Artificial sequence; identical to SEQ ID NO: 345
  Variable heavy chain of SC03-058

SEQ ID NO: 458 - DNA, 375 bp, Artificial sequence
  CDS (1)..(375): Variable heavy chain of SC03-059
atggcccaggtgcagctggtgcaatctggggctgaggtgaagaagcctgggtcctcggtgaaggtctcctgcagggcttctggtggaggcgtcttccgcaattatgctatcaactgggtgcgacaggcccctggacaagggcttgagtggatgggaatgatcaaccctagtggtggtagcacaagctacgcacagaagttccagggcagagtcaccctgaccagggacacgtccacgagcacagtctacatggagctgagcagcctgagatctgaggacacggccgtgtattactgtgcgagattccctggtggtaccagaagccgcggctacatggacgtctggggcaaagggaccacggtcaccgtctcgagc

SEQ ID NO: 459 - protein, 125 aa, Artificial sequence
  Variable heavy chain of SC03-059
MAQVQLVQSGAEVKKPGSSVKVSCRASGGGVFRNYAINWVRQAPGQGLEWMGMINPSGGSTSYAQKFQGRVTLTRDTSTSTVYMELSSLRSEDTAVYYCARFPGGTRSRGYMDVWGKGTTVTVSS

SEQ ID NO: 460 - DNA, 330 bp, Artificial sequence; identical to SEQ ID NO: 304
  CDS (1)..(330): Variable light chain of SC03-059

SEQ ID NO: 461 - protein, 110 aa, Artificial sequence; identical to SEQ ID NO: 305
  Variable light chain of SC03-059

SEQ ID NO: 462 - DNA, 3789 bp, Artificial sequence
  CDS (10)..(3777): Codon-optimized sequence of S protein of SARS-CoV stra in Frankfurt 1
ggtaccgccatgttcatcttcctgctgttcctgaccctgaccagcggcagcgatctggataggtgcaccaccttcgacgacgtgcaggcccctaattacacccagcacaccagctctatgcggggcgtgtactaccccgacgagatcttcagaagcgacaccctgtacctgacacaggacctgttcctgcccttctacagcaacgtgaccggcttccacaccatcaaccacaccttcggcaaccccgtgatccctttcaaggacggcatctacttcgccgccaccgagaagagcaatgtggtgcggggctgggtgttcggcagcaccatgaacaacaagagccagagcgtgatcatcatcaacaatagcaccaacgtggtgatcagggcctgcaacttcgagctgtgcgacaaccctttcttcgccgtgtccaaacctatgggcacccagacccacaccatgatcttcgacaacgccttcaactgcaccttcgagtacatcagcgacgccttcagcctggatgtgagcgagaagagcgggaacttcaagcacctgcgggagttcgtgttcaagaacaaggacggcttcctgtacgtgtacaagggctaccagcccatcgacgtggtgagagatctgcccagcggcttcaacaccctgaagcccatcttcaagctgcccctgggcatcaacatcaccaacttccgggccatcctgaccgccttcagccctgcccaggacatctggggcaccagcgccgctgcctacttcgtgggctacctgaagcccaccaccttcatgctgaagtacgacgagaacggcaccatcaccgatgccgtggactgcagccagaaccccctggccgagctgaagtgcagcgtgaagagcttcgagatcgacaagggcatctaccagaccagcaacttcagagtggtgcccagcggcgatgtggtgaggttccccaacatcaccaacctgtgccctttcggcgaggtgttcaacgccaccaagttccctagcgtgtacgcctgggagcggaagaagatcagcaactgcgtggccgattacagcgtgctgtacaacagcaccttcttcagcaccttcaagtgctacggcgtgagcgccaccaagctgaacgacctgtgcttcagcaacgtgtacgccgacagcttcgtggtgaagggcgacgacgtgagacagatcgcccctggccagaccggcgtgatcgccgactacaattacaagctgcccgacgacttcatgggctgcgtgctggcctggaacaccagaaacatcgacgccacctccaccggcaactacaactacaagtaccgctacctgaggcacggcaagctgagacccttcgagcgggacatcagcaacgtgcccttcagccctgacggcaagccctgcaccccccctgccctgaactgctactggcccctgaacgactacggcttctacaccaccaccggcatcggctaccagccttacagagtggtggtgctgagcttcgagctgctgaacgcccctgccaccgtgtgcggccccaagctgagcaccgacctgatcaagaaccagtgcgtgaacttcaacttcaacggcctgaccggcaccggcgtgctgacccctagcagcaagaggttccagcccttccagcagttcggcagggacgtgagcgatttcaccgacagcgtgagggatcctaagaccagcgagatcctggacatcagcccttgcagcttcggcggcgtgagcgtgatcacccccggcaccaacgccagctccgaggtggccgtgctgtaccaggacgtgaactgcaccgacgtgagcaccgccatccacgccgaccagctgacccccgcctggagaatctacagcaccggcaacaacgtgttccagacccaggccggctgcctgatcggcgccgagcacgtggacaccagctacgagtgcgacatccccatcggagccggcatctgcgccagctaccacaccgtgagcctgctgagaagcaccagccagaagagcatcgtggcctacaccatgagcctgggcgccgacagcagcatcgcctacagcaacaacaccatcgccatccccaccaacttcagcatcagcatcaccaccgaggtgatgcccgtgagcatggccaagaccagcgtggactgcaacatgtacatctgcggcgacagcaccgagtgcgccaacctgctgctgcagtacggcagcttctgcacccagctgaacagagccctgagcggcatcgccgccgagcaggacagaaacaccagggaggtgttcgcccaggtgaagcagatgtataagacccccaccctgaagtacttcggcggcttcaacttcagccagatcctgcccgatcctctgaagcccaccaagcggagcttcatcgaggacctgctgttcaacaaggtgaccctggccgacgccggctttatgaagcagtacggcgagtgcctgggcgatatcaacgccagggacctgatctgcgcccagaagttcaatggcctgaccgtgctgccccccctgctgaccgacgacatgatcgccgcctacacagccgccctggtgagcggcaccgccaccgccggctggacctttggcgccggagccgccctgcagatccccttcgccatgcagatggcctaccggttcaatggcatcggcgtgacccagaacgtgctgtacgagaaccagaagcagatcgccaaccagttcaacaaggccatcagccagatccaggagagcctgaccaccacaagcaccgccctgggcaagctgcaggacgtggtgaaccagaacgcccaggccctgaataccctggtgaagcagctgagcagcaacttcggcgccatcagctccgtgctgaacgacatcctgagccggctggacaaggtggaggccgaggtgcagatcgacagactgatcaccggcagactgcagagcctgcagacctacgtgacccagcagctgatcagagccgccgagatcagagccagcgccaacctggccgccaccaagatgagcgagtgcgtgctgggccagagcaagagagtggacttctgcggcaagggctaccacctgatgagcttcccccaggccgctccccacggcgtggtgttcctgcacgtgacctacgtgcctagccaggagaggaatttcaccaccgcccctgccatctgccacgagggcaaggcctacttccccagagagggcgtgttcgtgttcaatggcaccagctggttcatcacccagcggaacttcttcagcccccagatcatcacaaccgacaacaccttcgtgagcggcaactgcgacgtggtgatcggcatcattaacaataccgtgtacgaccccctgcagcccgagctggatagcttcaaggaggagctggacaagtacttcaagaaccacaccagccccgatgtggacttcggcgacatcagcggcatcaatgccagcgtggtgaacatccagaaggagatcgaccggctgaacgaggtggccaagaacctgaacgagagcctgatcgacctgcaggagctgggcaagtacgagcagtacatcaagtggccctggtacgtgtggctgggcttcatcgccggcctgatcgccatcgtgatggtgaccatcctgctgtgctgcatgaccagctgctgctcctgcctgaagggcgcctgcagctgtggcagctgctgcaagttcgacgaggacgatagcgagcccgtgctgaagggcgtgaagctgcactacacctgatgaattctcgag

SEQ ID NO: 463 - protein, 1255 aa, Artificial sequence
  Codon-optimized sequence of S protein of SARS-CoV stra in Frankfurt 1
MFIFLLFLTLTSGSDLDRCTTFDDVQAPNYTQHTSSMRGVYYPDEIFRSDTLYLTQDLFLPFYSNVTGFHTINHTFGNPVIPFKDGIYFAATEKSNVVRGWVFGSTMNNKSQSVIIINNSTNVVIRACNFELCDNPFFAVSKPMGTQTHTMIFDNAFNCTFEYISDAFSLDVSEKSGNFKHLREFVFKNKDGFLYVYKGYQPIDVVRDLPSGFNTLKPIFKLPLGINITNFRAILTAFSPAQDIWGTSAAAYFVGYLKPTTFMLKYDENGTITDAVDCSQNPLAELKCSVKSFEIDKGIYQTSNFRVVPSGDVVRFPNITNLCPFGEVFNATKFPSVYAWERKKISNCVADYSVLYNSTFFSTFKCYGVSATKLNDLCFSNVYADSFVVKGDDVRQIAPGQTGVIADYNYKLPDDFMGCVLAWNTRNIDATSTGNYNYKYRYLRHGKLRPFERDISNVPFSPDGKPCTPPALNCYWPLNDYGFYTTTGIGYQPYRVVVLSFELLNAPATVCGPKLSTDLIKNQCVNFNFNGLTGTGVLTPSSKRFQPFQQFGRDVSDFTDSVRDPKTSEILDISPCSFGGVSVITPGTNASSEVAVLYQDVNCTDVSTAIHADQLTPAWRIYSTGNNVFQTQAGCLIGAEHVDTSYECDIPIGAGICASYHTVSLLRSTSQKSIVAYTMSLGADSSIAYSNNTIAIPTNFSISITTEVMPVSMAKTSVDCNMYICGDSTECANLLLQYGSFCTQLNRALSGIAAEQDRNTREVFAQVKQMYKTPTLKYFGGFNFSQILPDPLKPTKRSFIEDLLFNKVTLADAGFMKQYGECLGDINARDLICAQKFNGLTVLPPLLTDDMIAAYTAALVSGTATAGWTFGAGAALQIPFAMQMAYRFNGIGVTQNVLYENQKQIANQFNKAISQIQESLTTTSTALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQAAPHGVVFLHVTYVPSQERNFTTAPAICHEGKAYFPREGVFVFNGTSWFITQRNFFSPQIITTDNTFVSGNCDVVIGIINNTVYDPLQPELDSFKEELDKYFKNHTSPDVDFGDISGINASVVNIQKEIDRLNEVAKNLNESLIDLQELGKYEQYIKWPWYVWLGFIAGLIAIVMVTILLCCMTSCCSCLKGACSCGSCCKFDEDDSEPVLKGVKLHYT

SEQ ID NO: 464 - DNA, 29 bp, Artificial sequence
  Primer XhoISpikeRevCOG
gttcctcgaggggccacttgatgtactgc

SEQ ID NO: 465 - DNA, 18 bp, Artificial sequence
  Primer SpikeCOG seq 1
ccaggtgaagcagatgta

SEQ ID NO: 466 - DNA, 32 bp, Artificial sequence
  Primer KpnINCFor
cttggtaccgccaccatgtctgataatggacc

SEQ ID NO: 467 - DNA, 28 bp, Artificial sequence
  Primer XbaINCRev
gttctctagatgcctgagttgaatcagc

SEQ ID NO: 468 - protein, 9 aa, Artificial sequence
  Peptide
RSAPRITFG

SEQ ID NO: 469 - DNA, 32 bp, Artificial sequence
  oligonucleotide primer EcoRIspikeFor318
cctggaattctccatggccaacatcaccaacc

SEQ ID NO: 470 - DNA, 27 bp, Artificial sequence
  Oligonucleotide primer XbaIspikeRev510
gaagggccctctagacacggtggcagg

SEQ ID NO: 471 - DNA, 1350 bp, Artificial sequence
  CDS (1)..(1350): IgG heavy chain of 03-006
gaggtgcagctggtggagtctgggggaggcttggtacagcctggggggtccctgagactctcctgtgcagcctctggattcaccttcagcggctaccctatgcactgggtccgccaggcgcccgggaaggggctggagtgggtggcagttatatcatatgacggaagtaataaatactatgcagactccgtgaagggccgattcaccatctccagagacaattccaagaacacgctgtatctgcaaatgaacagcctgagagctgaggacacagctgtgtattactgtgctaaagacggcagcccccgcacccccagcttcgattactggggccagggcaccctggtgaccgtctccagcgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 472 - protein, 450 aa, Artificial sequence
  IgG heavy chain of 03-006
EVQLVESGGGLVQPGGSLRLSCAASGFTFSGYPMHWVRQAPGKGLEWVAVISYDGSNKYYADSVKGRFTISRDNSKNTLYLQMNSLRAEDTAVYYCAKDGSPRTPSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 473 - DNA, 1335 bp, Artificial sequence
  CDS (1)..(1335): IgG heavy chain of 03-015
gaggtgcagctggtggagtctgggggaggtgtggtacggcctggggggtccctgagactctcctgtgcagcctctggattcacctttgatgattatggcatgagctgggtccgccaagctccagggaaggggctggagtgggtctctggtattaattggaatggtggtagcacaggttatgcagactctgtgaagggccgattcaccatctccagagacaacgccaagaactccctgtatctgcaaatgaacagtctgagagccgaggacacggccgtgtattactgtgcaagaggtttgtctcttcgtccttggggccagggcaccctggtgaccgtctccagcgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 474 - protein, 445 aa, Artificial sequence
  IgG heavy chain of 03-015
EVQLVESGGGVVRPGGSLRLSCAASGFTFDDYGMSWVRQAPGKGLEWVSGINWNGGSTGYADSVKGRFTISRDNAKNSLYLQMNSLRAEDTAVYYCARGLSLRPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 475 - DNA, 642 bp, Artificial sequence
  CDS (1)..(642): IgG light chain of 03-006
gacatccagatgacccagtctccacactctctgtctgcatctgtaggagacagagtcaccatcacttgccgggcgagtcagggcattagcaattatttagcctggtatcagcagaaaccagggaaagttcctaagctcctgatctatgctgcatccactttgcaatcaggggtcccatctcggttcagtggcagtggatctgggacagatttcactctcaccatcagcagcctgcagcctgaagatgttggggtttattactgccagcagaggttccgcacgccggtcaccttcggccagggcaccaaactggaaatcaaacggaccgtggccgctcccagcgtgttcatcttccccccctccgacgagcagctgaagagcggcaccgccagcgtggtgtgcctgctgaacaacttctacccccgggaggccaaggtgcagtggaaggtggacaacgccctgcagagcggcaacagccaggagagcgtgaccgagcaggacagcaaggactccacctacagcctgagcagcaccctcaccctgagcaaggccgactacgagaagcacaaggtgtacgcctgcgaggtgacccaccagggcctgagcagccccgtgaccaagagcttcaaccggggcgagtgt

SEQ ID NO: 476 - protein, 214 aa, Artificial sequence
  IgG light chain of 03-006
DIQMTQSPHSLSASVGDRVTITCRASQGISNYLAWYQQKPGKVPKLLIYAASTLQSGVPSRFSGSGSGTDFTLTISSLQPEDVGVYYCQQRFRTPVTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 477 - DNA, 642 bp, Artificial sequence
  CDS (1)..(642): IgG light chain of 03-015
tcctccgagctgacccaggaccctgctgagtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggacagcagtggtaaccatgtggtattcggcggagggaccaagcttaccgtgctgggccagcccaaggccgctcccagcgtgaccctgttccccccctcctccgaggagctgcaggccaacaaggccaccctggtgtgcctcatcagcgacttctaccctggcgccgtgaccgtggcctggaaggccgacagcagccccgtgaaggccggcgtggagaccaccacccccagcaagcagagcaacaacaagtacgccgccagcagctacctgagcctcacccccgagcagtggaagagccaccggagctacagctgccaggtgacccacgagggcagcaccgtggagaagaccgtggcccccaccgagtgcagc

SEQ ID NO: 478 - protein, 214 aa, Artificial sequence
  IgG light chain of 03-015
SSELTQDPAESVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 479 - DNA, 55 bp, Artificial Sequence
  Synthetic Construct - complimentary strand 5' cloning site of pPicZalphaB
agagagctcttttctctccgacttcgacgtccttaagtgcaccgggtcggccggc

SEQ ID NO: 480 - DNA, 55 bp, Artificial Sequence
  Synthetic Construct - complimentary strand 5' cloning site of pPicZFVH
agagagctcttttctcggtaccttcgacgtccttaagtgcaccgggtcggccggc

SEQ ID NO: 481 - DNA, 92 bp, Artificial Sequence
  Synthetic Construct - complimentary strand Synthetic hinge fragment
cgccggcgcggtttcggttcatggggtggtccaagaagtacaggtggtacaggtccgagaccgccacgcggttagctatcgccgaaagatct

SEQ ID NO: 482 - protein, 18 aa, Artificial Sequence
  Synthetic Construct - 5' cloning site of pPicZalphaB
SLEKREAEAAGIHVAQPA

SEQ ID NO: 483 - protein, 18 aa, Artificial Sequence
  Synthetic construct - 5' cloning site of pPicZFVH
SLEKRAMEAAGIHVAQPA

SEQ ID NO: 484 - protein, 30 aa, Artificial Sequence
  Synthetic Construct
AAAPKPSTPPGSSCPPCPGSGGAPIDSGFL

What is claimed is:

1. An isolated binding molecule able to specifically bind to a Severe Acute Respiratory Syndrome Coronavirus (SARS-Co-V) and having SARS-CoV neutralizing activity,
    wherein the binding molecule comprises a variable heavy chain comprising amino acid sequence SEQ ID NO:37; and
    wherein the binding molecule comprises a variable light chain comprising amino acid sequence SEQ ID NO:41.

2. The isolated binding molecule of claim 1, wherein said binding molecule is human.

3. An isolated binding molecule able to specifically bind to amino acid residues 11-19 of the nucleocapsid (N) protein (SEQ ID NO: 468) of Severe Acute Respiratory Syndrome Coronavirus (SARS-Co-V).

4. The isolated binding molecule of claim 3,
    wherein the binding molecule comprises a variable heavy chain comprising the amino acid sequence of SEQ ID NO:86; and
    wherein the binding molecule comprises a variable light chain comprising amino acid sequence SEQ ID NO:41.

5. An immunoconjugate comprising an isolated binding molecule able to specifically bind to a Severe Acute Respiratory Syndrome Coronavirus (SARS-Co-V) and having SARS-CoV neutralizing activity according to claim 1, wherein said immunoconjugate further comprises at least one tag.

6. The immunoconjugate of claim 5, wherein the tag is selected from the group consisting of a radioactive substance, an enzyme and combinations thereof.

7. A composition comprising the binding molecule of claim 1.

8. A composition comprising the immunoconjugate of claim 5.

9. A method of detecting a Severe Acute Respiratory Syndrome Coronavirus (SARS-Co-V) in a sample, said method comprising the steps of:
    contacting a sample with a diagnostically effective amount of the binding molecule of claim 1, and
    determining whether the binding molecule specifically binds to a molecule of the sample.

10. The method of claim 9, wherein the sample is a sample taken from a human subject potentially infected with a SARS-CoV.

11. A method of detecting a Severe Acute Respiratory Syndrome Coronavirus (SARS-Co-V) in a sample, said method comprising the steps of:
    contacting the sample with a diagnostically effective amount of the immunoconjugate of claim 5, and
    determining whether the immunoconjugate specifically binds to a molecule of the sample.

* * * * *